United States Patent 9,567,581 (SELECTIVE REACTIVATION OF GENES ON THE INACTIVE X CHROMOSOME) - sequence listing, part 24

SEQ ID NO: 3241 - DNA, 299181 bp, human
gccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatgggtgagtgggggccgcccgcgtccgggcgtccacttcagccttgagggcggcgcgccagtcccagaaccgcggagcccgggagggcgccccgggggcagggtccggacgggggacaccgcggtgggcgccctcgcctgcctcgcgcacccccattcactcccacttgcgcccgtgtgcccgccgagcccgcgcgcggcgccgacgggaacccgcgggggcctgagcagacgatcacgggggctggccccgggcggctcgggctgagggatgcagggggtgtggttggtttttcgggtgggcggggagagttttgtcttggccatttttgcacccgagcgcgccctcctctgcgctgcggacacgggcacccggacctggtgggctccggccctgcgcggggctgctggtgtcttcctggtcctgtctcgggggaagctggaacctcggggtcttggagggggctgggttgcctttgctgggggttgacaggggttggggggtggggcgggaaacgccccagttcctggtctggctcgcagtcccggggtccagagcacctgacgctcctctccttgcgccccccttcctcccggccccgaccctttcgctgctgccttcctccagcctggcgagctctctgctccgtgatgctaaaaggccacttcccatactgtcctttaagtcttcagggtctgggacctggaaatggtgatccggtctttgatttactgagtaaacatcagttcgaagtagccaactaacctttgaaccccctgggtcccatttgatttagaccccggagcattggaaccaccttgctgcccagagaagctgccactttattggcaaggcacttatgattacttgggctattaaatgtttggtctacccaggtaatgttcttgctgacagccagcttctgtttttcagcctctggcagattatttttggatgttcctaggccaggcataggaaggctgcagataataataaatcataataaagtgagacctttctgtgttcaggtaataggattccagtacactagtcaggatgttcagaaagcctgaaggattggaaaagaggaggtttaacccagtccgttgttgacaggcaaagttaaaatcccatttgtggtcatttgccaaaaaaggttttccttttctaagtagtggtgatctgttgtccccttggcttaaatgtcacttttttcacagtgcccttctctcccacctgtagtctaaattggttcctgttccattttctcatacaacacctttttttttcgtagcagtattacatatttgtgcgtaacagttatctcctctactgtaagctctgtgaccatagggacagcacagtgttgcatagtttgctcagcacttttggtgtgtggcacagagcaggacctaaatatttgttgaatgaatgaatgaggggcatgaaatcctcctcctctgctggggacagaacacttagctcactcttgttttgctttggcccataagatgatttagttcattggcagaagtatatactttaaaccttacaggccactttagtaatgggttaatttctcccgaggtaaccaaaaattctgttttgatcacctttcattttgggtgggtcaccgagagggttatgcacaaaaagaagttaatccaaatgtcttctcccatggccagactgtgctttctgtatctcaatgagaaggggactgagtctcatttaagaagaatcagacctatttttcagatttgaactgttttcattcttcagaacttcctacgaaaaatagagtgctcctgtagtttttagtccttttgtacttaatctttactgcaaccattattgcagggggagggggcatcgattttcatttatttcaggagttaatacttagaggtgataatgtcaaaacgaatgtaatttaattcatgtttatagtgggatttaaggtgcttatagtagtttgtggctaaaaatcacctgctcttttgaaagcatctccagcagtatatttgtaatgaagtgcagttatttaacggttcattctgtatgtcttccaatggagtgatctaatgggctgaggttgtgtgtatgcagacagaggcccaccctttcccccaagtctctggttttcagatttatccagtttatcaatttgatgcaattttattcttttttaagagggagggtctcgctgtgttgcccaggatggatttgaactcctggactccagatcttcccaagtagctgggactgcacgctcacaccactgtgcctgattctgatacacttatattcttacctggcctgataatgagttttctcttgatggataacatagtaaaactgtatcttatatttcgttttctgaaaaataacagaaaagaaccaaatccctaaccctgaagtgaagctggttagttgcaacatggcctcttataaaagcccatcagaatgtgccctctgaacttgctaggagatgcatgcctacagtgccagacacagagaaagcctcttataattacaattaaacagatattatggtgacccaaatctgtgagtagtgaagggtttgcaagcccacaaatgatttctgtttaattccagagtaacaacaaagtttggatagcctttggcaatgtatttattgtattggcggtagactgctgtatgctaaactaaagctaaaatgaacataatgtgttggtctgtacaaatgtcttgagttagaaatggaagaaaaggctcccaccttaattgtacataagctttacccacttctatccatcttggcacgagcaaaagcttgctgtggctctggttacacaaaccttggtggtttcttctcttactacttcagttcttttggcgttactgacattctctcatcaactcttgagtttgtagttgtttttaatgtattttgcatacagcagtatttgttcatctatccatccatccatccatccaatgtttgttgatcttctttgcataggcactgtgctaagaacaggtgcagaacagagacatgacactttgggcttctcagtctaatgaaggctgacttgaatgcaattctcatggcagtatgtagctgaaagccatagtagagcgcatgaaagatgagtggagaaggccaatctgacttagcctggagagtgcccaggacagtgtcttagaggagattgtgtttgagcagaaatctggttgagtatgagtcatcactgccctccagccacacctggttcttgtggcagagactgaaaacgagcaccgtgggaaccgcggggcatctcagtaagatggtacaaggaaggatgacttagagggcttgcacctgtgtcaggtggcttgagggcgtgtttaaggaagctgggcattactttggattggatgctaccagggggaatttgtgattgggtattttaacaaatgttctctaggagcagggaacattggaggcaggccacagctatggttggtaaagcagcagcagtcatttgcattatccaggattgggggatatttggtcatgtgtgtggtttggacaaggtgcatgttttgtccgtgttcagacatgattaatgtgtggtcttgttttcatcttattccatcctggtcgcagagtggccttgtctgatgttggttttctagggaattgtttctgttcaacaggacaccctggcccagctgtgggtgcctggccagctcccagccagaagaactgctctttctccgagttaactatgtgacaggcaggggcagggaatcggaggcagtgggggaggaaaatggctttctaggtatatctgtggctacttcatatcaaccaggtatagcctggactgttgttcaatgctaagcacgatggacatctgaaatgctatactaagggaagagagagtgacagagaaagagcaagctgctgagaaccatgaagtcagtgctaatgggaaagacgcagaacaggaaaatagcccaaatacttagtgttagagaaggagagcctctaatgcagcgcttctcagagggtggccccaggccagtagcacagcctcccctgcaacccgttagagatacagattctctggcttcattccagcagacctcctgaatcaggaatgctggggatggggcccagcaatctgcattttcatgagtcctccaggtggttctgatcatagtccagtgtagaacccctccttgccttacagttgagaaagctgacatccggagctcgtggttcactggggtacacaaggcactctgttcataagactattataagtcttatgttataagtactgttataagtgactcattaccttagaggagaaagacatactcctacttcaaaacacacttcttgtgttaagacagtacagtgtggattcttccacgaatccagtccaacccagacctccaacacctaggcattagtgacactaggcagccgatctcagtgttagtctctgagacttttaccagagtatcacacaggcacttcccagcatcctttaccctccatcctctttaaaggggactttaagttacactgtttgcattattccagggtgtaatatttgttcatgattttctatacctggtacctgtattcgtttctgattgctgctgtacctaccacagacttagtgcctggagacatcacatgtttatcatccgtcactgggcgacaatcacgaagtcagcagagctgcattccttctggaggctgtaggagggaatccctttccttgccttttccagcttccagaattggcattcctttgcttgtggcctcttcctctctccaaagccagcaacggctgggcagctctctctcccatcacatcattgttactgactcttctgcccctcttttccatgtgtatggactcctgtgatgacattgggtccacctggatattccaggctcatctcctcatctccaggtcagctgatcagtaagtttaactcccctttgccttgtaacctaatattcacacatcctgggctttaggatgtgggcatctgggggcggggagggaatgttattctgaccactacactgccctgtggtggacctgacgtttcctggtttctcttggataactgtgtgttcatagtcaactgccctgtccctccttgggaagattccatctttggttctatttagatttttacagtttattaataaagccgccttaaagttacatcttgcattcacctttcctcttcactgctgtttttttgagacagcttgtcccactcttcccctttcctcacatagcctgccctacacctaccaggactctggcactgccttgattgtgttctagaaactgatcatgctgaggttatcctgaatgatccttctccaatcacgaagtacatggtctcaggcctcaccatgtttgacttcactgaagcttgagattgaagactggaagtctttgtcttctagaacaccctattttttcctgatttctcctacagtcctcccttcttttcttccacccctgtccacctgtggaatgctgtcatctctggtccccttatgtttagtgtgtccttgagtgattgcagccactttgccaattcaggtgtcgcctattgacgatgcccacatctgtccccagtcttggtctctgttctgagctcaggacccacccactataagcaccacaagggcaggaacctcgtcagtttggtcattgtgttcctgtgcctggtacactgtaagcctaagattaacattggttgagctgattatcattggtatcctctcctagctaacttcacccaggtgtgtcttagacgcctcagactgagcatgttgcaaactaagcacagcatttctcctctgtaatgcctgccctgcctctttttacttcccatttcattgagggtatcaccatctttcctgtcacttccacagggacgctgctattgttccttgcctcttgttccttcccctttccctgccccttctgatgtacagtcaagccctaagtggctctggaattgaccctatgtgtctacccttctgcaaatgctttagatcctgaatgccttagtgaagccttcgtgaagctcggcagccaccaatgctttcgcttattctaagctcattcaggtctctgagactttgcccacgtatttcccttcatggggaacagatgtcactctctcctctgccttgtagactccctgtatcagtttcctattgctgcagtaacaaatcactgtgaacctagtggcttgaaacagcacaaatgtgtaatcttatagttctagaggtcggaagttcaaaatggatcttaccgggtcgatatcaaggtgtcagcagggttgcgttctttctggaggaattcatttccctgccttgcccggcttctagaggctgcctgcagtgcctttacctccttcactcgtaccccagccctccaacctctgcttcagtcctggcatctcctatctttcaccgagccacctgcctgccttttatgaggaccattgtttgacactgggcccacctggataatccaggatcccctccccttctcaggatgcctggtgaatcacacctgcaaagttcctgttgccatggaagggaacatagtcacaggttctggggattaggatatggccatctttgggaagtcattgttcagcctcccacaccgcttgtgcatctgtgggagcctgctccaaaggtgtgctgtaccatactttgtttaaaacattttttatttttaatttttgtgggtccatagcaggtgtataaagttgtggggtacatgagatgttttgatacaggcatgcaatgtaaagtgatacaacatttcctcttgtattaagtctccatctccaactggatctgctcagctccattgccctggcacattgcctggcatacagtaagtgccatatgttaatgaatgaacatgtaaccctttcacccaaatacggttacaacttgcaattctccacgactatggaccaccaggagtgagtgtgcaattctgtaaagtcccctgggcagagcatgttgacaaggtctgtttgctgacagttcctggtggcccacactgtagtgggtgagaagggtgatgccacatgtattacatggctttaacaaagaactgcacattttaagatagaaaattctctctggcagtggttctgaactgggggcaattctccccaccagggggacacagcactatctggagacacttttggttgtcacagctggtggcgggggtcaggggagtggagagtcattctactggcatctactaggtggaggtcaggggtgctgctaaacatcctacgatgcacaggccagccgccccccgcaccaccacaacaaagagttatctgaccccaaatgtcagtcatgctgaggttaaggaagcctgctctgggggaaccccgggggcttattaacacagatggctggagcaccatttccttacttcattatcagtccttctggaacataaggctttgtatgtaaccacagtcttcgttttatgcacgaacctacaagtcactagagaacaggactctttgggactttcaccattttgttctttgaatggagagtgtcttaacacaactcttgcctctcttccgttgatacctaggtagttaagctggggagaggcaagggctttggggcacgaagttgttaaacttgcttctggtagtgtttggcccctgtaatgttttgtctttctattgggatgtgcttttatgtggggggacaggcgatgggtcctctgctactcacatattggtccctggcattgaagtgctggaaggagccttggcagtcatggcccatgacatcagatgatgagactgagcctcagagaggcagagtgacaatggtcccctagtggtagaacccaactgccttccagtatggaagaaccagccccgcccaatttctgtaggtgctcagaaaatgtcaggctcctgcttcccctcgtgaggctcttgctacagtctctttccgtagtaagttttttattttttattttttgagacagggtctcactctgttgctcaggctggagtgcagtggcgcaatcaaggctcactgcagcctcgacctcccaggctcaagcgatcctcccacctcagccacccaagtaggtgggactacatgtgcgtgccaccacgcccagctaatttttgtatttttttgtagagatggggcttcgccatgttgcccaggctggtctcgaactcctgggctcaagtgatccacctgccttggcttcccaaagcattgggattaggcatgagccatcacaccagggtgtaagttttttttaaacagatttattgatgtataatttgcataccatacaatttatccatttaaggtgtgcaattcaatgggttttggtacattattaattttatgctaaaacatgtaacaaaatttgcaattttcaccacttttaagtgtatagttatactgggtatattcacaatgctttgcaaccatcaccactatctagttccaaaactttctttttttaaaatcacccctccctagtaagtttctaacttgaaggtcagaatccatgtcccctgggggttcctggaccagccagccaatttggagaacacttggaagcccaaggatcccagttgagattccaaaggaagataggaaaagggaaagcgtggctttttgtgtgtgtgtgtgtttttggttgatatttccttgggaggccctttattttctctctctctctctctctctctctctcacacacacacacacacacacacacacacacacaaattagccaggcgtggtggcacatacctgtagtcctagctactcaggaggctggggcaggagaatcacttgaacctgggagcaggaggctacagtgagccgacatcgcaccactgcactccagtctgggcaacagagtgagaccgtgtctcaaggaaaaaaaaaaaaaaaaggtctacatcatgggagaaaacactgcagtgccaaacagatccctcgaattcacacacatggttgatatcattccacgtttcttcacttaaattccttcagctggcaaaggtccaccagcaacctgtgatcatgagcacttggttttcaacttgatcattatcttatggataaatatcttgcaggcagttctgtagttttcattaggggatgcttaaggcaaaaggtagctcatgggtcttaactctgtggtcaactgtgcttatatttagccttacaaagaaaaaacactaataacaaaaatcctgtgatacttgtcctaacggaatactatccagttggcaagaaaagaccagaaaaggcctctgcttacttcctttctgtggccacggaagtggtgggggcactgctggaggctggtccatctccaggtgtgggtgacagagtggcaagatgaagtgcagttcagttcatactgttatttctatcttggataaaatactataaacatttcaatgcttattaatgactcatttggcataataaatttaagtccttgagcacccaagtacagcatgtatagacagtttaaacaaccatctccttacacttgagcttcttaccagccagtatgcaaacaccagcccttgtgtttttgccagatttttctggactgttctagacttagaagacttggggccatgttctaggtctggtcctctggggctgcaccagttttagccatcacatgttacctccccatgtgaaaagtctttaattagcttagtgtcctgtctaattattccagctagttcttaggtttgtgcctggagctagacggagacgcttggccctcattttggatgaagactgggaaaggccattcttgctctgctgccccctcctcttagccagcatcttcatggacctcaattttcttcaccagggtgttctgggtgctgtcttttgatgagcattttacataatagcttctcaaattcacttgacagaagtgacttcgtaaatgaactttgcctttctcctgttttgatcatcaaaacaaaaccagcaaaaacatctcttcacaacttgaccgaaatgggacagttttaaaccacttagccagtgatttctaattacccctttgttctcaacaaactattagatggcaaagagaggtgtcaactcaaatacagtaggtcaatgagctcatctgtgatccatgaagcaggatggacagagtaagtgtttgttaattgatggtgatttttttaaagcttaattgctgcttttggctgtcaggaaacaaatgaaagtaattggcttgcggagggtggattgtggggggaaaagtgaggtggaagatttcaccaattgaagaaaaaattggaaagggggaagcagttcacactgtcttcatctgttttctggggcataatgactacagctgcttgcttgagacatttttaaagttagtttttggaataggttatatatccccaggattcgaaattcaaaaggtgaaaaagtgtttacgggaaaaagtctccctcccatctctgtccttcagctatgcagtgaccctccccataggctgctgctattttgtttctcaagttttcttccagggagctttcatatgtataccaacacagaggcatttctgttattttcccctccttttttaacgtcctgattaattgatgatgggtgaacttctgtctagctggggattttctcccccccggagatgtgcattggaacgctatgcctagtccttccatctagttttgatggagggataggtggacttcggaaaagttctccaggagactgctctattgtcctgaggctcagctgatctgggttattaattgacagaaactttgtcctggatcttaacccatctaggtgttttttttgtttgtttgtttttgttttcttgacagagtctcactctgttgcccagcctggagtgcagtggtgtgatctccgctcactgcaacctgtgtctcccgggttcaagcgattctcctgcctcggcctcccgagtagctgggattacaggcatctgccactatgcccagctaatttttttgtatttttagtggagatggggtttcaccatgttggccaggctggtctggaactcccgacctcaggtgatctgtctacctcagcctcccaaagcgctaggattacaggcgtgagccaccacgcccggccttaacccatctgggttttgaactcaggaacagtcttcccactttcatgttgtatatatagtaaggactttcttcaaatgatagaagccaagcagggcccgctaacctgagcaaaagggatgcttattctggggccacagggacctctcatgcaacccaagggtgcctgctggaggagccggaccccaagaagcagcagctggagctaggtgtgggccagctgcccagtgtgccctctggccatgcttcctccctgtcccctttcttctgtgtgacttgttcatggggcacatgccacagttccaaatgcctgttaagtgtgacttgatttggtcccagttccacatttttgttagtgagactgagcccaccggagcttctgtctcctcccacctccaccctccatatacacaggtggctgctccatgcccacatccatggtgggcgggaggtgctcagttccagtcctggtgtaaatgttgaaggagggcgcatggaggacccaaatgaagccctgccctgtggaggagtgggtgctacggggctgccctcgggccaggcactctcagtgaggatgctagaccgcctgccagtgttggcattcattttccctgccctcctcttgacaaaggagtgactgatgtgaggccgtgtggcctcttctgtgctctagccatccaggatgttcattccatcctcacagagtcccttctatgaggctccctgaggaagggcccttgtcggagccgagaacagttgtgcttcagagtaatggggctattttaatcctttgagctcctgaactgtgtgactaagctccatgtcacctattgagttggcggccgttaaaaagtgtgtctgtgcctctgggggcccttggatgggttggtgatagcatgccatgggggaagggtacagttgtgacatcgtctggcgcttttagggaacctgtgggtttttaaatggaggaagagatgtagacattgtaaaaaacagccaccgcctgacgagttaacccctgaggtagagatgcgctccagaaagcgggcagggggctctcgccctaatgcctatctcctccctcctgccttctccccctctttttctcctctctctccccctaccttttctctctctgctctttcttcatcccctcaccctttctctcatccctcactcctcttcaccctgtctccctcactttctctcatccagatccatctcccctacgctctttgtccccgcatctctctcccattcccctgcaccccctctccccttccaccctcttttccacaccccttctccccacaccttctctttccctcttagtctctctccccgcatcctcactgtccacccccagcctcctgaccctccccacttctgctctcccttcctctcagcccctctgtgttttgcccctttcttcccagcccgttcctcttattttctctcttcctcacccctcctctcctggcccctgtgtcttacccttctcattgcccacatcccttctccactgcccccttctccacacttcctctcctgttcttactaagcccttcttcctttcttcttccccctcctgcctctcttctctcacccctcaacacctccacacccccccactttgcccccccaactcttcctctcctctctcccatcctctcatctgcccccaagcccccttttctgtctctctgcccacttctttctcccccgaccccagttctctccccggaaccccactctggccccagtgcccactctccctcaacccctcttctctcttgcacttcctcctccttcccacattctcccatttcttccttcaaacccagtattgctgcgtgcctcagattttcaatcccacagggcaggaagagccagggacagggttactggccttctccatcccacagccagccatgggtccctactctagaataactgtgatttttattttagtgtacttcttttagagttttatatatatatatatatatttttttttttttttttttttgagatggactctcactctgttgccccggctggagtgcaatggcatgatcttggctcactgcaacctctacctccccagttcaagggatccccccgcctcagcctcccgagtagctgggattacaggcgcacaccaccatgcctggctaatttttgtatttttagcagggacagggtttcattgtgttatccaggctggtctcgaactcctggcctcaagtgatccacccacctcagcctcccaaagtgctgggattacaggtgtgagccactgtgcctggcactatttcttttttcttatgaactcctcttactatcattcccaaatattttggtgtatttctttttaggttttctttatttttatttttattttttttgatagagtcttgctctatcccccaggctggagtgcagtggcatgatctcggctcactgcaacctctgcctcctgggttcaaacgattctcctgccttagcctctcgagtagctgggattacaggtgcctgccacctcgcccggctaattttttgcatttttagtagagacagggtctcaccatgttagccaggctggtctcaaactcctgacctcgggtgatccacccaccttggcctcccaaagtgctgagattacaggtgtgagctaccatgcccagccagggtttttactattaatatatacttgttgctatatgtacatgtattttatatatacatgtatatatatgtatatgtatatatatatatatatatatacatatatatatatatatgtccttgttttttccacttcatagtcatctttgaagccagtgtttttagtagctgaatatttgagttcatgcatcttaatttatgtaactatttccctgtcatttgagcatttaggtagcttctatgatcttgatattatatagacgaggatgtgatggacatatgtcccctttctatcctgtaaggaaatcacactgtaggcagtgtggcattttatatccattctttatctccatagatgcccaaatgactggactggcccctgatgatgagaaggaagaagagttcagtccaagggaattggcacatgggaattggcagggtacttgtcctccatgtgtttgctttcagttttagttctagaaactctgtgttcatatggcttatcatcccttttatatgtgctctgtgtgtgtgtgtgtgtgtgtgtgtgtgtgtgagagagagagagagagagagaagagagatggagacagatcaactgatacttcttttttttgagacagtcttgctctgtcgcccaggctggagtgcagtggtgcgatctcggctcactgcaagctccgcctcccgggttcacgccattctcctgcctcagcctcccgagtagctgggactacaggcgcccgccaccatgtccagctaattttttgtattttttttttagcagagatgaggtttcaccgtgttagccaggatggtctctatctcctgacctcgtgatccgcccgcctcggcctcccaaagtactgggattacaggcgtgagctaccgcacccggccccaactgatacttctaaaagcaactgcatgtgggcttttatgttccacagcactgtccctatttcactgcaccactgtggggcaattaatcctggtctcgagttcaggtgtaagattagaggatacacagtgaaaggtgaaatccttgggggtttggttcctttgttttctctcccgctttttgccattctttttctttctttctttctttctttctttttttttttttttttttttgagatgaagtttcactcttgttgtccaggctggagtgcaatggcgcgatctcagctcactgcaacctccacctcctgggttcaagcgattctcccgcctcagcctcctaagtagctgggattacagccatgcgtcaccatgcccggctaattattgtatttttagtagagacagggtttcaccatattggccaggatggtctcgaactcctgacctcaggggatccacccacctcagcctcccaaagtgctgggattacaggcgtgagccaccgtgcccggccaccattcttttacctgactgatatttaagggaattttgtttcccagaaccatagggaaaactgtgtcctgaaggccctgagccatccatgtgacttcatgtttggctgagataggggtccaagtcccttgctggcaagggaaaggtcgtggctgtaataatccccttgtggtttctagcttagctttgtgtcatcatgcactcctctgaaaaaattgtgctcttagctttaaagggcaccacgtaagggtggctagaacccccaggagccaggctggatgaaccatctcaacgccttggcctttttaattcatcactttcagtaatggacaggattgtggaaagtattcattcttcagccaccaagtgtacgtcaaatgtcagctcatgtacctgttaaaaaaataagttgaatatttatgatgccatctcaggggcaagtttcagtgaaagttctaaagttcatgataataaatgttagaaagcattggtgctaatatgtaccatatactttatccctttgttaccttttcaaattgtgaacataacctgacttgaatttgtaggacaaacaaaacagttgactcaatactgctgtgtattggaattcaattaaattctagaagtgtttattgagtgcctgttaagcataagatctgataaccaggggaactcctcaaacatatctagagtttccctcaattgttcatttttcttaactttcatttccctaattgggtgaagattgtgatgtggtcattttatgaatcgcccaacaaaataagcagttaaaccaaagggtgtttgtttgagaaagttctatttatccagaaagaaggaaagatataaattttagcaaaacacatcaaattagaagacagctttgtgagatagaaaaatgtctagtcagtctctgaaactccctcctcactggtagtttagagagaaacaaaacagaatggggtttctcaaatgagtgctaaagttcccctcacaaggaaaacatttcccaataattcctgctttgccttaaacccactaccatgaagatcagcagtaacaggagacacggcggtgtgcttcggccgtgaggttgttgcttggtgatgtgacaggcacatactgcttgctctggtgcggtcttttgtgttcacttgcttatcccatctcttttctctcttcaaaccactgtgagaatcccttcacacagttctctctgaggccttctcatgtggtgctacacaataaaatcagttctggaagctgatatgatagttgatgtcatgtctatgacatcaaacatcattataaaatgtatagtagtgggctgggcatggtggctcacgcttctaatcccagcactttggtaggacaaggtcagcggatcacgtgagcccaggagttcgagaccagcctgggcaacatggcgataccctgtctctatttaaaaaatacagaaaattagccaggcatggcggcatatgcctgtagtcctagccacccaggacactgaggtgggaggatcacctgagcctggcaggttgaggctgcagtgagccatgatcgtgccactgcactccagcctgggcaacagagtgagaccccagctcagaaaaaaaaaaaaagaaatgtgtagttgtggactcatctcttgatgtaagaactaaaacactgctccagctctgtcccctccctcctctttccctagaggaagcaaccaccctaagtctttttaaaatcatctttcttcttttttaagaaataattttatcatttccatatgtatctcttaaaaacaaacatattgtctggttttgcttgtttttagttttataaaactgggaccgaaactgcagagacttgtgatttgcttgttgtctctgattttgcagttcatgtgtttttcctgtctggtattccattgtttgaacatgccactgtatacttaccctttctccccgatggacttttgctttgcttccagttttttgctgctatgtacagacttcccatcaccatttgaatgaatgtctctggtgtatgtgtgaagtgtatttttttaaatgtgcatagcaaggagtggttttgctgggttttaagttgctggatttccaaagtgttgtgccagtatatgttctcaagaactgagtgaatgaacaaactaatgaatgaagaagataacatattcatggaaggagagagtatatgaatattcagctttagaagagaatgcctaattgattttcaaaatatgtgttcctagagtgtaaacatctctgctactccctgttctcgccaatatttggtatcccagatatattgggatataggctaaactgccatcacagagaccccaagacagcatagctgtttccttctcaggctactgcctcctgaccactggactggtcagggtgagtgaattgctttgctcagattccttctctcttgtggacatggtcggagctggctcaccagcactgtgtccacctttcagcccatggcagagggaagtagacggggagtagcttctcttcgttaaggacatgacatggaaactgcttacatcacttccacccacaccccattgcaaagaacttagctacagtctcacacccagctgcaggtgagtctgaggaaacaggctccagctgtgtaaccatgtgcccagcaaaatctgaaggcagaggagtattaatttcctattcctgctgtaataaattaccacaaatgtaatggctgcaaacagcataatttattgtattctagtttgtgaaatcagaagtccagaatgggtgggcagggctgagtgccttctggaggctctaggggaggattcctttccttaccttttgcagcttctagaggtcaactgcatgccttggcttctggcctcttcctcacatcaccctgacccctcctcccttcatctcatttccttttccggctcttccatcttttaaagatccgtgtgattacactgggatcagccagttaatccaggatactgtcctcatgtcaagatccttaatcaaatctgtgaagtccctttagccactttaggtggcatattcacaggttcggggaattagggcatggacatactttgtggggattggggagcattattctgtctaccgtaggggaagggatgggttctacagacagtccctgacttataatgggttgattgaatggttttctgattttacagtggtggaaaaatgacatgcattcagcacattcctcatcatgtccccataaacccatcgtgagttgaaaatatcctaagtcaaaagtgcatttacaacttaggatattttcaactcacgatgggtttatgcagatgtagccctgtggttagttgagaagcatctgtattttttaaaagaggaaggggataatgggtactagagagaatgatcagtttctgccatatcataccatcgcatttttgccaatcacatggctgtggatatattttaagtgttaagttgtcagaactggtgaatttgctgaagagaggactttgttttctgatactttgtgattgtcgggattcaaatgttgaagtaatcctaaaaaacaaagcatatttttgaggtctttctcatgagtgacaatttcatccatcagtcttctgtttgccacagtccttttgcggagggcattcccatccactgttgtacttgtagcttcctcagcgaagctaacagagcagctagcatccctaggattaaatgacaaggtgcgtattaagatcccggcgcacagtaggggcccagatgtgttacaaataaacaataacaaaagcccacactagcacatcgtggccagagccgccttgtgtgcaataatcacctcatcatacattgcatgcacatagtaggtagacaaatcaaaccctcctttcctaataccctctggccctccagcttgctgtggactggacgtttgcatccccctcctattcattcctgtgttgcagccctaatccctcatgttgtgttatttggagatggggtctttgggaagtcattacaggtccctactcctttaggcagctcgatttagaagtctttttcttttttctttcatcaatttttttttctttcatcagtcactttcttctgataatgggggaggttaagtcgctaatttgtcaaatttatgtgcactcatttttgtatataagataggacaaactttctgtggtgataacttaggagtctgcaggggccagcaagactcatttgtcctttcctggatccagcagcaccatcctcggccccttttcattgcctccctgggcttcactaagactgtgcttggacccttccttccttccctccatgttgtcctaggccctgtcttgagaaatcttggctcttagcctggagctgacaaattcttgcttaggaggtggaagagaatcgcatgtctgactaaaataattcatacacactgcagttgcaatttcactttcctggggtttataaacaggaagacaccaccaattggggatgagttatttatttttgaggggggttcgtgagacatcttatttatctttgttttacttggtctgctggaaaatgcaaggaaatccgatttgttgtagccagacataattccctcttccctttcctccctccccacccctaacttggctgcttcctgaagcacaggagaagggtcaccacttgaggagaaggcacatgctggttcaggaagccccagtgggttcctgcaaggactccaaaaattatgctctgtgagcactagtttccctggcgcccaggccaagaccacagccttctcaggtcttcttgtctatgccggtatcactatgcctggcacagtgtctcaccaacaggcagcgaaagaaaaattttgttgaaagagtgaaaacaacatgtgactttaaagccagagcctcattttccccaaccagttcagaaatttaatgggatcgcatattgacttctgctcgagtgcatgttggctatggttgaggcgaccgagaaagccagcactactcagttttccctgctcttggccttgtcgtgttgtaaggtctgtttacgtttggatagtatttctctcaagaggcctaaaatataggtaaaatcatcagtgacgccatccatgggagaattttggcaacacaacagcatttgtgcctagaccacttctgctgtatgtatgagaatcttcctgtggcctttgattagccgttaacagaaatttcttttttttcttttctttttttttttttaaagagacagggtctcgctctgttgcgcaggctagagtgcagtggtgtgatcatggctcattgtaccctcaaactcctgggctcaagcgatcttcctgcctcagcctcccgagtagctgggaccacaggtgtgcaccaccatacctgcctaatattttaatttttttgtagggatggaggtctcgttatgttgcccaggctggtctcaaactcctggcatctcggcctcccaaagtgctgcaattacaggcatgagccaccgcatccagccctcagaagtttcttttgcattgaacttgccaagaaaagacccatttatatgatcagccccttgtaaagcgcgtgccctgtcttcagggtagctgaggggctagcttgttttactgtcccctccaaagtttccctgccatggttctaccatagaagaaatcttctcctttatcttccttagttgtggtcagctttcaggcttgccacacttcctcctgggtgagtaaagaggcacatttgggtgccctgggttgggcacagtagatttgaggtaagggagccagagtgctcatttctgcagcagggctctcatcctgcattttagggaagtgtctctggccccctgcaatgcgggatgtttttcttcttttttcctcttgctttatgttagcttgaaccagtccctggtgttttgcttcaggattcttttcttcctccctagggagtaattgcttagaaaatgccctcctgtcaaaaacacaaagtcttcaatgtcataaattggtagtggaaactcctccgtcatctggcttaatatttgaactgttgctaatggctaagagattgcagcatgaaggtgggtccctttggaagcctgttgggtcaactggggtgttggctgtctcctttggtcagtgtgtgtacagtcatttggggaccagcccattcatcgcaggcacttcaatcttttaatgctctcactctttgaagaattataggagccatatgctgcttcccaggtaaccgagacttgctaaaaatagagcttaaatggccccactgttctggcattggaaatcgttgctttttatttttaggccagcttgtgtgatccgtagctactttcaagcttgggcaataagaatcactgagcaagacctttgtcagttgaacactgttaaggtttgaacctccactcccagctagttggaaggagaatccaaatctattgaaatagggagtgctgaccttcacatggctcccctcctccacctccaccctctattaagcaggattctgtttcactgtgggtttagggtacttaccacaagaaaaatacgttgcaaagaatgaattctggctgtgagtttatggcaccagccaaacaaccagaagaacagactggcataaaacagctttgaggccattaaagaacaccaccaaggccgagacccatgcactgtgggttttgggtggtctgaaatggaaattgtcatcaccatacttaggtgcagattaatgcattaaatgataaataagaataggcctaacttccattgctcatttcataagtaatagtctcattttactatccccattcttgcccaccttcagttacagaaataactctgagtgggtttgctttttaaagatctgtgtcaagcagatatctcacaaaaatggcacaggcaaagtgttctatttagaagttgccctgtgacacaaaaccacagtgtgttttcagtccttgggcactggtttctttggacataagtgctaggggcatggtgccggccttccgggggaagtgacttgaaagtgctgtgggctccgcatagagagttttacttcattaacagtcgcttatccgtcaggtccaaaagacgcagcggtggtactggtaaccaggtatattcgtttcctattgttgccctaacaaattaccataaaatgagtggcttaaaacaacacagattttactgtcttacagttctgtggtcagaagtttgatgtgggtctcactgggctaaaatcaaagtgctgactgggctgcattcctttttggaaactctaaggaaaatcccgttcccttccatttcccatcttctagaggcagcccgtattccttggctcatgaccccttcctccatcttcaaagccaccaacagtgacccaggtccttttcaggttgtgtcacttgatcttctctcctgtgcccccgctctctttttaagaacccttgtgggtacattgggtccacctggataatccaggcgactcttccttttgtaaggccagctgatgagcaaccttaattccatctgcaactttcattcccttttgcttgggattgggatgtggaaatctttgcagggggtgggggggtgttgttctgccaatccacaccagggactttgttttcctaaatctccatgtcgggtagggccaaaggggcaatcattttggtggcagcctacgtggaagatggcttctatatttgcagagtttcaggaagttgagagggtttctcttagaccactagactgtgaagtttgtcagataccttgtttctctgtagggtggtcctggagttttgatgatcccagctgagactcttaccaggggctgctagagcctggggatggatggctgtgaaggggagcagggagttaggatgactggtagcagctgggctggccagcgagcgaggaatgaggaagcagggggatgaggacaggaaatgatagacgagtctgccccttgggagagagaaaatagaagatggggttgattacatctggccccaaagaaaataaaagcatgggcttttttgtttgtaggctttgtgattgattctactgttgagtcaacttagacgctgggctaaacaaatttatttgcttactttttggacatccagtgcactcttgccactaaaagcctcaggggttcattgtggccacttggtgtcccgagggaggttggggggtgttgggtgtcactgtccaaacaactctctctggagagagcagcagcccagctggggaccccgtcccaggagggctctgctctggagaatgtaaaccggtctggtacaggctcacagagccttaaatgtgttctcaagaattctaacaaataatctgttgtgaacttaaactggtttggactttgaagaactgacaagttcttttgagaaatagtacgtgggagctttgtgcatcctttcccacggtcccatgactgggaggtatgttacagtgaaagcaagtctcagacacgttttggccactcattcagacacttgttagtaagcaggcatgaagagagccctgctttagctgggcgtggtggcacatacctatagtccctgttacttgggaggctgaggtggaaggattacttgagctcaggagttcaaggctgtagtgagctatgatcctgtcactgtactccagcctgggcaacagagcaagaccctgtctctttaaaaaaaaaagagagcacactgcagtctgttttgtaagctcagcaaagcttgagccctctggccgggccccttttgggaaagagacattcaaggcagatgccactgtattccagtgccgggattcagctaacccccagggaggggacagggtcctcctttagtggttgacaatggcccctgacagtcctgggcctcttctctgaagggggcagactgctgttatttctagattcttttgtgcggttcttctgaggatggagatggtggcacaatattttcacccaattcctagagcagagggccactgcttgttttcatcatgctaattaaccaactctggtgcaaatggactctgattagtctttcaaatgctgatccaccatccctggagtgcttgtttttcatttggatacttcaattgtgagctgacctcttttaggataaggatcaaagccaagtaatacagagctatatgaggagacttcaacaagttcatggaaaatgggtattatgaaaaaactattcatggatttaaatttttttttttttgcaccaaaataaactcacactaacttggctgtaacatgtctgaatagtatctagtttgaggcactaagaaagataagacaccagtttggaaagagcccctatcagagcaacatgaattctgctaaaattgaagcaagaacaaacaccaaacttatagtgaagcttgagtggaagaatggtgaaataactgatgctttacacaaaatttatggggacaatattccaaagaaattagcagtttacaaatagatagctcattttaagaaaggacaaaacaatgttgaagataaggtctgcagcggcagactatccatatcaattttcgaggaaaaaatttatcttgtttatgccctaatagaagaggactgacaattaacaacagaaacaatagccaacaccacagacatctcaattggttcagctcacacaattctgactgaaaaattaaaaccgagcaaattcaatgggtggcaaaaccattgctcccagatcaggtgcaaacaagagcggagcttccagtggaaattctaaacaggtgagatcaagatcatgaagaatttattggaagaactgtaacaggagatgaaacacggctttcccagtgccatcctgaagacaaagcacaatcagagcagtggctaccaagaggcggaagtggtccagtcaaagcaaaagcggtcaagagcaaaggtcagggcaacagtttttggggatgctccaggcatgttgcttgttgacttcttggagggccaaagaacaataaaatctgtttattatgacagtgttttgagaaagtcagagcatgagcagaagaacatccaggaacagttcaccagagagttcttcaccatgacaatgctcctgctcattctcattcctcgtatcaaacaagggcaatcttgtgagaattttgaggggaaatcattaggcatccacttcacagtctgtatttggctctgactccttttttgtcctaatctttaaaaaaaatctgtaaagatcacctattttccttcagttaataatgtgaaaaagactgcattgacatggttaaattcccaagaccctcagttctttagggatgaactaagtggctggtgtcatcacttgcaaaagtgccttaaccttgatggagattatgttgagaaataaaatttataattttatcttttaattctattttccatgaactttttgaagtcctcatatagtacactgtttcttttttagtgtggattgctattttttttattatttatttttatttattttttatttatttttttgagacagagtcttgctctgtcgcccaggctggagtgcagtggcgggatctcggctcactgcaagttctgcctcctgggttcatgccattcttctgcctcagcctcccgagtagctgggactacaggtgcctgccaccacgcctggctaattttttgtattttttagtagagacggggtttcaccgtgttaaccaggatggtctcgatctcctgacctcgtgatctacccgccttggcctctcaaagtgctgggattacaggcgtgagccaccgcgcctggcctgctgtttttatttttaactttttattttgaacaaactttagacttatggaaaagatgcaaaaatggtatagtttccatatatccctttcccagcgtcccataatgttaacatattatataatcatagtactattattagaatcaggaaatcaacattgctatcatactatatatctaaatgctatatgctaaatactatactatgctatactatatctaatactgtactatagatcttgcttaatttcatcagggtttccactaaggtcctttttttgtggttgttctaggttcctcttcagaatccgtgttgcatttagttatttctcctagtctcctgcagtctgtaacagttccccagtctttcttgattttcatgaccttgatgcttttgaagagttattttgttgagtatccctcaaattggattggactggggttatgccttttaaaaatcatggtaaaatatacataacataaaatgtacgattttaaccgttttaagtgtacaattcagtggcatcacgtacattctcaaggttgtgtaaccattatctgtttccagaactttttcatcatcttaaacagaaactctgtacccatgaagcagttacttttcattccccctccccccagtccctggtaatcacacttgtactttctgtctctatgattttgctgttatgggtacctcatataagtagaattatacaatatttatccttttgtgtctggcttctttgacttagcttttgaggctcatccatgttgtagcatgtatcagtacttctttttttttttttttttttttttagaggtgggatctcactgtgttgcctaggctggagtgcagtcactgttcacaggtgggatcatagtgcattacagtcttgaactcctgggctcaagtgatcctcctgccccagcttcccgagttgccggggctacaggtgtgtgccactgtgcctggcctgttcctttttaaggctgggaataatattccatagtatggatagagtacattttgtttagccattcatctcttggacacttgggttgtttctaccttttggctagtgtcatttatgctgccatgaaaatggatgtatgaatacttggttcacattttaaaaggaacttggagaaactggagaagagacagtttggagcaggcagaaaaaggcactattttgtgtttcccatccctgactgaggctttcacagaagcaagggagattgagatgcagtggggcagggagatggcaagtggactcagagacaggtgccagatggttgagaggccaggaggggacagggagcccaacctattatacttgtccaaaggtgctgccactaggggaatgcccagaaggtgcaaacaagcccactggacagggtcaaaggcctaggaaccagtaggagaatgggttaagaccacgatttgctgcagaaagcacagtttgctccacaccacccagagccaggcaggatggtataggcatgggttgggttgaaaattaagtccacttaatatttcttcttgatgtttttcaaatttgggggactatcttccagtaagaaatatatcttaccttgcagccttgtaaacacacctgtctttagttatgattgaaatagtaatttcaggctgggcatggtggctcatgcctgtagtcccagaactttgggaggctgaggcgggtggatcacctgaggtcaggagttcaagaccagtctggccaacatggtgaaaccccgttgctacaaaaatacaaaaattagctgggcatgatggcaggtgcctgtaatcccagctactcaggaggctgaggcaggagaatagcttgaacccaggaggcagaggttgcagtgagccgagattgcaccattgtactccagcctgggcaacagagcaagactctgtctcaaaaaaaaaaaaaatagtaatttcacaacaaacatttgatgtgctctcatattttctatgcagttctgtttcattaaaaaatgcttcttgtgacctgggttcctgggttgccttcatcttgaaaacactgtactacacaaagcctcatatgcgaagttctttctgccagttacttttctttctctatcaagtttttgtccctttccagttggaaaatgtaaaccatgtaattgatcacgtttctctttttgttttggctatgaggcaacacaaaccttggcttgaccaagcgataggtttctatatggcggtcatatactgtacatactgatgccttaacttttcctagctcttgaccttctagctatatttttcctgattctaattggtcatatatttttgttttgttgaattcttgggagctgccacaaatctatatggagtgtgatgatggaatatataacaaatcatggagaacttttgatcttgactgagataaattgttgagtaaagtctgcatctttagagattttgtttttgagacagggctttgctgtgttgcccaggccggagtatagtggcatgatcatggctcactgcagcctcgaactcctgggttcaagccatcctcctgcctcagcctttggagtagttgggactacaggtgtgtaccaccacacctagccaattaaaaacagtttttctttttgtagagatgggatctcactatgttggccaggctggtcttgaactcctgacctcaagtgatcctcctgccttgtcctcccaaagtgctggtattacaggtgtaagccactgcacctggtgagattttattttttttgtgaagcacggtctgggcgatatgattttcttttagctttatgattctccggtttacttttctggcttttgtttcagattacctagaaagcaacctcttcctttttaatttaattttatttattttatttttattttattttttaagatggagtcttgctctgtcaactatcctggagtgtagcggcacaatcttggctcactgcaacctctgcctcctgggttcaagtgattctcctgtctcagtttcctgagtagctgggattacaggcgtgcaccaccacacccagctaatttttgtgtttttagtagagacagggtttcgccatgttggccaggctggtctcgaactcctgacctcaagtgatccacccgcctcggcctcctgaaatggtaggattacaggtgtgagccactgtgcccagcccctttcctttttaaaaaaaggaatttatcatagtggcaaaggtagaattcaaggaagtttggaattagtgtggagggaaggtgtcatttcatctttaattaaggccgtttttacttgtactcacattgcatagaattctgtttacgcaggtgtttttgtttgtttgtttgtttttttaacagaatcttgctctgtcgtccaggctggaatgcagtgacacaatctcagttcactgcaacctccgcctcccaggttcaagcgattctcctgcttcagcctcccgagtatctgggattataggcgcatgccaccatacctggctaatttgtgtatttttaaagagatggggtttcaccatcttggccacgctggtctcaaactcctgacctcaagcgatccacccatcttggcctcccaaagtgctgagattacaggtgtgagccactgggcccagccacaggaatgtctcttaatcaagctccttgcttctattcccctgcctcatctcaagttcccattcccctacttgatttaccatgtttgctgtctaactagtgtgttcctgccacctgcagcctctgcccatgagtccttctgccgcaggtgtcatcagagaacacatatttatagttatacttcctctctgctcccaaacctccagttactccccagacttgcggataatgcagtcttttgagcttgtatcaaggacagagcccatcttgccaattgattagagcaccccagctttcaccctgccctccccgcctccagtccttaggttggaaagctctgagagaggatgaaatggacagaccatctgatgcatatggacctcttgagagatgatttagaccagggaggatgagtttggagttgaatccatttttaagtgaactctccactaagcaaaaaaaaaaaaaaaaaaaaaaaaaaaaaaaaaaagactagtattagctctaggggaaaagaaactagtgataggaaagaaacataatcttagtgtaccatgtggctaggcttttagtaatgtttgtgtagtcataaggatgtaaatacttgtgttagttttgtagggctgccagaacaaagtaccatggattgggcaccttcaacaacagaaatgtgttgtctcacggtccgggaggctggaagtctgtgatcaaggtgttggtggggttggttccttttgagggccatgaggttcctttcgaaggctgtagttgcctctggggaggggaagttggggagaatgaagaatgctttttttccataagagacctttacagctatttgaaactttaactgagtgtgagggtgacttgggtgacctgggtcagcatagcctgtgccgcctgcaccgagctgctcttgccttcattcgaggtgagaaaaggaagtggggatgttatcggccttaaaggtcgctactgacaagaagtgaagtcttgggctttctgaggcccgtttatcatttcattctaaaataacccaatagttactttttagctccttatatgagatctactttaagatactccaaagcagggctttttgggggagggtagtgtagtttattgcatttttgtaattcttcagaagatatctactttcttctctctgttgcagttattgatttagaagcaagctaggagcatatgacagaaactgtcagtaacccactctgaagttaattttgttttggttacaggtaatagtttcatgtctacttctgtggggaacagcagtgatagatttcctctcctttttttttttaaaagctttccttttacctgtgcaaacctctcagtctccccatgctcccatgatgcgatgggggagacactgaacacccaaatgggcatttctatctgcagaaaccctaagttccttctactggtgttaaatagcttgtggaatgtgttagtctgttaagtagccagtggaatgaatgtattaggtcatctgtggaaacaattagaagaaaaaaatctggcaaaggagcagaccaggaaagtttaaaaaaaaaatcctttctggcacgcagttcaattagattagtatgagttgttagaaattaatgtttgcggtgtcagtgagcacacttaaacgacaaaaaagaaactcagttgcagtatgtggcacatcattaaacatatactcagatgtttatttaaaaagtatagatctgtatttcttgtatgtgtagcactgagccaggtagaggctatgtgtagcactgagccaggtagaggctatgtgtagcactgagccaggtagaggctaagagtaaatgaaaatatataatacctggtcctttctcttaaggagcttaaatctgtttggaggtagcaagacatagaatgtaaaagataatgaaagggttaaaataacagtctgagacagggatcagcaaactatagcctacagctaaaatctggccttctgattatttttgtaaataaagctttatggaacacagcctcactcatttatgtttgttgtctgtggctgctttagtgctgtaaaggcagatttgaggtgttagagtggaacattggtcccaccaaagctgaaatacttactatctgactctttaagaaaaagcttaccggcggggcatggtagcttatgcctgtaatcccagcactttgggaggctgaggtgggtggatcacctgaggtcaggagttcgagaccagcctggccaacatggtgaaaccccctctctactaaaaatacaaaaagttagctgggcatggtggtgcgcacctgtaatcccagctactcaggaggccgaggcagaagaatcgctaattgcttgaacccaggaggcagaggttgcagtgagccgacatcgcaccactgcactccagcctgggtgacagagtgacatttcatctgaaaaaaagaaaaagaaaaagcttaccaactccttgtctgggataataattcaaaagatgttacaaagcagtgtatgaggagtaaaagtgatttagtgaacgctatagttagtaagtctgagaatgatggaatgacaggtggcttgaaaaagggttttgaaggtgacctcagaccaagagattggagggcactttgtgatgtaaagagttgggaaggagatttcatggatgggagcatccatggggctcttgggggaagatcgtgtggggagatggggaccaggactatccagctggacttagagccaggtataaatgcaggtgacgttgttaatgtcaaacctgtaccatattgaagcggcctttgagttccaggatcaagactgggaacttcctcaaacccataatatctttcaaaggcaacactcatttacacaatcaatattcattccagacctattatgtggttgactccaaggggatgttaacatacatgtaggcacatcgctctcgtagactggtgagtccagcttgtttgactcagtgctagttctaggtatgtttaaagaaatagctgccggctgggcgtggtggctcacaccagtaatcccagcactttgggaggtgaggcgggcagattgctggaggtcaggagtttgagactagattggccaacatggtgaaactccgtctctactaaaaatactaaaaattaaccgggcgtgatggcacatgcctgtagtcccagctactcaggaggctgaggcaggagaattgcttgaacccaggaggcagaggttgcagtgagccgagatcataccactgcactccagcctgggcaatagagcaagactccatctcaaaaaaagaaagaaagaaaaattgtcatttagaagagaggtttaacctcaagaccctccaaaggctgctaataccaggagacttgtatggacaggtagtctcccattctgtgaggacagtgttctagagagagtctttgagaagggacttctggctgttgtttttttttttagatggagtttcgttctctcttgcccaggctggagtgcagtggtgcgatcttggctcactgcaacgtctgcctcccggattcaagcgattcttctgcctcagcctcccaagtagctgggactacaggcgcccaccaccacgcccggctaattttgtatttttagtaaagatgggatttcactatgttggccaggctggtctcgaactcctgacctcaggtgagctgcccgccttggcctcccaaagtgctgggattacaggcgtgagccactgcatctgggcgagaagggacttctgaaaaggaatgttgtgtaggtgagagatgtgccagggggaagggaggaggagaacccccacccatccttagacactgtattgtccttccttccttttagggcttctgtgctgtctaccattttttttctgggtctgcaaagctccctgcacatatcctcgcagggtgtgcttccaccctttaggtacccagccctatgcagttggtgagacatcataatgtttccacatgccaccatctcccctactccctgaccaccccctccaagcctgtatcctgctgtcttggcatctgttaggcactgagcttccccactttccctagatcagtcctgccacaggccactgagctcacctcaaaatcctttctctcctacctggacacagccctggggcacctgggccctgcttgtctctggccctgcagtggtcctcattgtcacccattaatgcttccatttacttctctctcactcttttttcttttgtaaattaaaacacacacacacacgtgcacacgcacatacacacacatacacagagacagagataaaagaaaattctgtagtgcattttgcagtgagtttattccagactttctctcctcaagctcctcaaattctcttctcacctgaccctaaccaagagatgaccttgattcctgtttaagagaaggcgtcaactcgcttgtgtactctcatcttcatggctttatatcactgttgtaatgttgatccacttttatccaatgccagagaaagatacccttccttcttttttttattgttctctgacttctctccgatcatgcattcctgactcatctgcctgttgtccagcatggtgaccctgtccccgcagaccgtcagtaagtacttactggatcaaagagccattctgtctgagaaaatgtcagctaagaatgtagaagggcagcaggcctaatttggcctggtttcatatttgaacctactgcctatattcatgtgtgcaattgggtatgttcgtggatttttttttttttttttttttctgtgcagctacagtatctggaacatatgtctcagaaaatctttattgattgaaaaaaatatgagcaggaacaggggcaagaagacggactttgagtccagactggctggcggctggaatattatctgatctctctgggagttggattctttcctaaaccaggaacaataataggcaccttgtagagcgtattccagttcctgttgctgtgtgacaaattactccaaaatttagcaccttcaaaaagccattttatgcttaccagttttgtgggtcaagcatttgtacagggcgtggtagggagggcttgtttcagctctacagtgtctggggcctcggctggaaaggcctgaggtttggagtggacatgacagctgggggctggaacgatctgaaggctgggtccctcacatgttgggccaggctgggatgactcagtaactaggcatgccagctggtgtgtctcagtgcaaattggcttccttacagcatggctgtcttggggtattccagcaagtgagttggaaactgcataatatggcctagaagtcacacagcatcactttcctccactctgttggtcaaagtggtcaccagcctgcccaggttccaaagcccggggaggaagattagatttctcctgttgacagctggatcacattctagaagagctcaagggacaggagatgttgctgtagccatcttggaaaacacaattggccacagagtgatcgttacagttaaatgatacagtgaggaggataaaggcacctgacacaagattttaagagtatattttctgccgggcatggtggctcatgcctgtaatcccagctactcagggcgtcgaggcaggaggatcagtagaggccaggagctctagatcagcctgggcaacatagtgagaccccttctctacaaaaaataaaataattatctgggcatggtggcaggtgccagtagtcccagctactcaggaggctgaggtgggaggatctcttgaggccaggaggttgaggctgtagtgagccatgatcgtgccactgcactccatcctcggtgacagagtgagaccctgtctcaaaagagtatattttcatttggtaaacatttatgaagttcctactatatatcaggccggtcctgggtctacagaggcaaacaaagcagacatgctgtctgtcctcctgtagctttcagtctagtggcggacacaggcagtaatcacatgtaattagatctggaaattcctcctccttttctggacaggggctggtgaaacatctggattcgtgtgttgcattttaagtgtttttcttttttttccccagtgaatgatgaggaaggggatctgcccattgttaatgtggaacctcttgctgctgtttgttttgttttgatacttctacagatctggaggctcatagcactgaaaggtgccttgtcaggcttgaggtctgcaagcaccccctgacccttttgttcagcttcagacttatgtttctctttctgcaaaagggatttaggagagtagtaggggtacatagagtcacctgggagatcatcttcagcctagacatgacccaccctgccccccgccccattctgatgggaaccagggtgtggaggagacaggcatgagaaagtttcacaggggattctaacatctctgggtgaggaacccagtgtgagatgggccagcgcttcccaaaccatcccatgcatgtgagtgtcctggggatcttatgatgcagcctcagattcagtaggtctcggggaggctgggggatgcctctgagtagtgagggtatgtggagtaccaggcgggtacagatagagatgcctgtggaagtttgctgcaccctgacgaaagggccagttctcagagagttagggtgctgagggctagccaggtgagctaccagatttctgtcatgtttcagcacgcaattcttacagataattactctgctaaaaaccataatcacaatatcacttttacacctaaacaacgcaaacaacagccttccttatgtaaaacacatctcaagaaactcaaattcagaatgttggcagaggtggccttgtccacactcatagatctggtgtagaacacacttttgattgtgctacttactcatttttaagtagcttatatgtattttttaagtagcttatatatcccagcactttgggaggtcgaggcgggcagatcacttgagttcaggagttcgggaccagcctggccaacatggtaaaaccccgtctctactaaaaatacaaaaattagccaggcatggtggcgcgtgcctgtaatcctagctatgcagtaggctgagacatgagaatcacttgaacccaggggcagaggttgcagtgagctgagatcgcacctctgcactccagcctgggagacagagcaagactctgtctctaaaagaaaaaaaaattatagatgcccagtaccctttataacaaattcaaatattgaaacatacatatgtatacaatacacacatttaatattttgttgcctttaaaacccccatcttcctttccaggtgcattgctatgcccagcatggtcagctgaatcatttgtgaaatagtgattacaccagctagagttacgccagcataaagatttgcatgttttcagttcagtgtaggacattattcttctacttgcacatgtagagcattttaacaatccggaagtgtttcagcatatattttgtaaagataaggactcttttcaaaaccataatcacaatcatttttacacatacagcaactaacagtgtttccttatcatcagacatttaagttcaaatatccaatttttacatgtagtttaaatattttaaaaggtgtttgtttgaatcacgatttggaaggtctgtactttctaactggttggttgtctctgagtctgtttttttttttttttttttcactctgctacccaggctggagtgcagtggcagtctcagctcactgcaactgctgcaacttccactttctgggttcaagtgactctcctgcctcagccgcctaagtagctgggattacaggcacgtgccaccacgcctagctaatttttgtattttttgcggagacggggttttaccatgttggccaggctggtcttgaactcctgacctcaagtgatccgtccacctcagcctcccgaagtgctgggattacaggtgtgagctaccgcacctggcctctgagtctgttgtaatctaggttctgccatctctttttccttgcttttgttgttgttgaagaaactaagtcatttgcctacagtcctacagcctggattttgcagattgcctccttagagtgccatttaacatattttcggacgttctgtatcccctgtaaactggtggtaaatccagaggcttgatctgattcaggttccgtttgttggcaagaatattttgccagcggtgacacacacttccatcatgaggctccagatgcctggttgtctctctttttgtaatgtccacagctggccaggcacggtggctcatgcctgtaatcccaccagtttgggacactgatgccagaggatcatttgagcccaagagttcgagaccagcctgagcaacatagtgagactctcatctctgaacaaaaactttaaaaaataagccatgaaatttaaaagaaattaaaaaaaaaagctggatacagtggctcgcacctgtaatcccatctatttgagaggatgaggcaggaggatcatttgagcccaggagttccaggctctagtgagccatgacaatggcactgcactccagcccaggtgacagagtgagaccctgtctcaatcaatcaatcaatcaatcaatatccacagctgctagtgaccattgctcaggttcttgattgcattagaggttgcaaaacgttgattgtccaattctctcattccttcttcattttattagccagaatattcctatacagagaaatttctcatcaaccatttggttatcttgaattcatataggaaaggcaggacaaatgtttgattctttttttaaatttaccagtttcaaaacaatgagttggctccctagcatcttccaaaggtggccaatgatgttttaaaagtatcactgtgaaagatatatcacataacatatgagacatcaaattaatttgatgtctttcaatccagttattgttactaatgcagttattatttcagtgcactttcaatgctgtttcaaggcagttattgttaatcatgctcatgttgccccatttgtggccagtgggagcctcttcaggttcacttctgagttgttttgacatgaccctagtagtgtttgctggcctccttgctttcttggtgtgacaagatggcccaggcttatcacctttcctgccccagaaatgaaatcagccatttatctaagggtagctggctttctttttgtgaaaaacggtatttggagactgaatgtgattatttcagaaaaaaatgtatacattgctcttcatagatcattattcttaggagtcttttggtgtgaggctgttgatctttttaattttatttacttattttcactaactcatatttcaattttgggaaaggtttcaaaaattttaaacccaatccagtttatttaggttttattctctttttcgaactttaagctataaccttcaaaggaaagcaaatgttgggttttaacttcacttcttttttgtgttactctatatagacacatacttactcagtggcttcctgatgctgcaataaagtatttacaatgtagttgattaagaaaacatttgtgaagtagatacttgactagcaactttttagttcaaattattgttcaatattaaaaagtaccaactcaaatgacttacaaacgttggtagttactgtcttgatagactcccaattactatgtgacatcattggtgaaacttaggatgaaaccgtgaaatgcaccctccctaataacctgcacattatggtgttgcagatatgctagatggtatctccagattagatgtctgggagcctaaagtagttatacttatgacagtttgaaattctagactgctttgaagagctgttattttgctgttatcttctgcttttatccctgtacatttgtctcagatctcatctcagattctcagcttcttgtcaaaatcatccttgcaagtttcttgcccctcgacaacaagcatttcttgagtgcctgacggggccaagcactcagccaagcacttgagggaggaagatgcattgggcaatatgacttttctttcaggaggcccatcagcttctgttttacatgtcccttttgccttctaggggctcgcggtagcaggattactacacctgggagtataaatgaagcctgagatgggacattaaatctgccggggagaaagcagtgaggattcactgtggtttcctctcacgttacctcactgtctgctatctctcttatgagaaagtatgtttcttaacagaaggccatgcagtgagtgactcagcccttgcccacccccaaccatgctgaccaaccacatttttctgtggaatcgttcttccctccttttgacttggtccctgcctcttacagctgattcagcttagccacactgaaatcaacaggaaggcttttgcttttcttctttcatacaacatgtccaaatataaagccaacctgcccccttactatcctatcctcaagacaagcaagagttgctttccatgatagtccttacaaagtatcctgtaccataaaggctctatgaatttattttgaataaaatagttggagcaaatccttcagataccttatccataataaaattgtttcatgaaatgagagggtgttggggggtggggagcgatgttttctaattattttatttcacataatctgtaattacattaatacatagtataagcagacacttgactgtttcttcttctgttttgaggtttacatattcaggttagcccacaaccttttggatcttctcactgagaaaaacaggggatctctttctaatcaggcacttgtctttgggtcttttttgaatctgagaactaggctatcattataaagtcaggaaaatctctactcatcctcaagccattttattatgtaacactgtcaaatatttatataaagcagcatactttcttctccatgcacaaaaaaaggttatgtctttaagtggctaaacttttttgactaaacagactttttattaaattggttttctggccagatgtggtggctcatgcccgtaatcccagcactttgggaagctgaggctggccaatcacttgaggttaggagtttgagaccagcctggccaacatgatgaaaccccatctctacttaaaaaaaaatttagctgggtgtggtggtgcatgcctgtactctggaggccaaggcaggagaattgtttgaacccaggaggtggaggttgcagggagcctagatcgtgccactgcactccagcctgggcgacagagcaagacactgactcaaaacaagaaaagaatattgcttcataaacagttgtgcctagtagctcaggagactacaattaagtccatttaaaaaatgtgtttttctgagattccatgtaacactacctgaaaaaaagtagaatgatgggaattaattggaggctctaaaaactaaataagaatatcgggccaggcatggtgactcacccctgtaattccagcactttaggaggctgaagtgggtggattacttgatgccaggagttctagaccagcctggccaacatggcgaaaccccgttctactaaaaatacaaaaattagctgggcatggtggcacatgcctgtaatcccagctactcaggaggccaaggtaggagaatcacttgaacttgggaggcggaggttgcagtgagctgagatggcaccgctgcactccagcctgggcaacagagcaagactccatctcaagaaaaaaaaaatggttttctaagattccactgatttttcccctccgtgattgttgtatagaaccattctctacacaggcttatccagctttaacctgttgtctttattttttactaggttttgttgttgttgtctgcctgtttgtttttgagatggagtcttgctgtgtcgcccaggctggagtgcagtggcatgatctcggctcactgcaagctctgcctcctgggttcacgccattctcctgcctcagcctcccgagtagcggggactacaggtgcccaccaccacgcccggctatttttttgtatttttagtagagacagggattcaccgtgttagccaggatggtctcaatctcctgacctcgtgatctgcccacctcggcctcccaaggtgctgggattacaggcttgagccaccgtgcccggcctgttttttaacctgcaaagtcacctgcccactttctccattctttctttttcacttaaaaagccttcttctggtcaagttatttttatccagtctatctaatggatattctattttttgagacggagtctcactctgttgcccaggctggagtgcagtggtgccgtcttggctcactgcaacctctgcctcccgggttgaagcaattctctgccttagcctcccgagtagctgggattacaggctcccgccaccacgcccggctaatttttttgtatttttagtagagacggcgtttcaccatcttggccaggctggtcttgaactgctgaccttgtgatctgcccatcttggcctcccaaagtgctgggattacaggcatgagccactgcgcccggcctctaatgcatattcttaaaagagctgtgtgttaggtttgcaggggttaatttcaggaagcgtttgataaccctttgtttttgctccttgaggttttgttccagggacagcccctggtgaggcagaggcttcagaaggcaagtggtaggggactcaaggcccacaggtcttgtgaatgctttcccatccaggccctgcatttcattctgatctttgattgaatgcccctctgctatataggcattggttgtggtgaaggtaagagtgaaatcaagactgatcacagtaacttgagaggcctggactagtggcgtatacttgttttgtggccaactggtcatgttgatcatcagctttctctagccttcaagttaaataacaaggctcacatttgtaactgcatttctttgagttgaatggtaaggtatagttcgaggtcagtactttgtaaggacactcctggtgtcgtatggtgcactcagtcaccaacatttattgagcacctactttgtgccagacaccagacgaggaggagagggtgctcagatctgccctttaagagctcccattccagggtgtgtgtagggagggcatgtcggggaagccctcacagcatagcatgataatgacctgcaagactagcatctggcattaatggagcagcttctgtatacagtttacagatatcacgtctcacccttgccacagatcaccttctgattttaaacacaaagaaagtgggctcgagctaggaatctcaccccatgtcacacagccagtgaatgtctaagctggaatttgctcccaggcctgctgggctttctcctacacctcatgcttagaggtgacaagagaggagagatgggctgggaggctcaggttccttgggccttcgtggaaagcagcaagtgacaagagtatccttaatggtgtctgaggcaggcaatggtgggcctttctttcctctcacacagccgggtttgttttttctcttctttcttgattcatctcttttctgctttccctgctgctccccaattctttgagctgctactgggcctgctacagacattgttgaatcctgccagaggccatccagccacaggtgtgctgcctcctgcccagggagagagttcaggcccagggactgtctgtcactggggtccgtgttctgagcctgtctttgttggggaagctgatgttcagtttttaagatgcaggtcttgggaattacctgcttgttgggttgatgtcccttagtggtgtgtttgtgaagacaccaaaaggaaaacgtggctggtatgtaggtcagctttattgtacgcggagatccccacagtatctgtggccttgacctgggaaattcagacccccaaacccttcagccctgacactaatgggagggcactggatggtaagaacttggccttgtgcagacttgcatagagaagagtctgtgtgtatgtaaagttgatgtatggccaggcatggtggctcacgcttgcaatcccagcactttgggaggccgaggtgggtagatcacctgaggtcaggagttcgagaccagcctgaccaacatggtgaaaccccttctctactaaaaaatacaaaaattagctgggcgttgtggcaggtgcctgtaatcccagctactcgggaggctgaggcaagagaattgcttgaacctgggaggtggaggttgcagtgagccgagatcacgccattgcactccagcccaggggacaagagcaagactccgtctcaaaaaaaaaaaaaaaaaaaaaaaaaaagttgatgcacgagtatctgttacggttctctggttttaagtaaaagaaaccaactcttccttaactaaggtagcaaaaaggatttatcagaaggcattggggtagtttatagggtggaaggagaagctagaggatcaggtctgagaaagatggcaactgggcagcttcagggatctcacttctgagagccctggtgggggaatctgctccagccgtctccagtgtttgtcacattgctttgatcacagttgggtcctatgtcatacattggctggcagagggcagggcatgttgatggacagtcccatcaaactatctcatggtggaggggaagttcccccaaacagttcccctccctgcatggggagtgttctcctgctagggcacaaacacagtctaccacctcaatgaccgacaatctacaataataaattcttaaatatatattgtttagacttttaattttaatattattatttttttgagatggattcttgctctgtcacccaggctggagtgcagtggcatgatctcagctcactgcaacctctgcctctggggttcaagctattctcctgcctcagcctcctgagtagctgggattacaggcacgtgccaccacacccagctaatttttgtatttttagtagagacagggtttcaccatgttggtcagactggtcttgaactcctgaccttgtgatctgcccgcctcggcctcccaaagtgttgggattacaggcgtgagccactgcgcccggccaatttttatttgtaaaagctgtactgaggtataaaatttcacccattttaagtgtacagtttaatacttttcaagtaaatttacagcatcctgtaactctcaccacaatttaatttgagaatatttccgtcaccccaaaaagattcttcatacccatctgcagtccatccccattcccatccccggccctaggcagccactgattggttttctgtctttttagatttgaacatagtttttttttaaatatgttcctgactggtgtaactttttctgggtattctggaaactatgttatacatgaaagaaaaaaagagcccccccccacccccccgcccgcatcaatggtgtgaaagtctgtatctcgctggtctcaggtttctctgctttctcttttaaatccttccttctctccagtggaccataatttaggagaacgtagccctgggcttgatgctgccattatttacctctcaatgtctctaagcctaagtcatggaaccttctaggcctcagttcctcatttgtaaaattcaggaaaaaaaaatagactagatgatatctgatgttctttccatctctaatgatcagtactcatgatcttttttggtgaagtctgttttggcaaaaaattacttcttgattttctatgcccttcagaggactgaaacaaaacactaaaattaaaaatttattcttcagaattcacagaacacaataagtgcaaaagcagtaagtgtgtaacatttctacttctgaaatgattaaagcttactgcactgagacctctgtgacattgtgtatatgtgtatacagcggaggaaattaattggaaactttcattctccttcatgctttctggtttattcaaatatttattgaagcagacaggatgctaggtgaaggatttagaatcctggcaaagataagggcttttcccagatgaaggttgcagtctagttggggtaagtcagtgtgaaattatagtgaggtgaactggtcctaggagacaggaaggacagtgagcagagggaggtagggaaggactgggtcacagagcagggccacggatataccaccgccaccaccaccgccatagtgagaagctggccctgagaagctgctaggcagctggcttagccaacccacagttaaaaaccacccatttcgtctttgggggaggagacattccagcaagtttgaaggtagagataggggagggtgaagtgttttgcatttctaagcagatctcttatctcccctggctctatctttttgtaacatggggttaactgtagcattggtttttgcagtgactgtagatgtagcaaacttgtggaggctggccttttggcacagcacacagctggagggtggtatttttctgacagggagatgttcttaagttttgtaatttatggtgtctttaaatatgggattttgtttactgttatcctaattacacctctgatgtattttatttagcttaatgttttaattttctgctcatacccagaggtaatttctcaaagggtaccactttaaaaaaatcataggtaatgtttcatccttcctgcagttacctgcagcctctcgaaggcaaggaaatgggttttgggggcatagactttcttctgggctcttgtgatataattttggctgtgtttgtatcatccaagatcttcaccacctgtttgccaagtattatcctaaaccattctgttctatagagacgtgatacaagccacatgtcattttaaatgttctagtagtcacattaataaaattttaaaaaggtaaaattaatttgtataatatatttatttaacccaacagatctaaaacatcacttcaacatgcaattgatgtgaaaataatgagctatttcacattatttttttctaaacaagtctttggaacttgggatgtatcttatggcacacgtcagttcagactagccacattccaagtagtcattagccacatttgcagtgacactgtattggacatcaaagttctaaacctttcaaaggcttgcagagggcactggaaagagcccttagagtgggtaggagagacatatcctcatgatttatgagctcttaacaaagccacaggtttcctcttcttagagaaacctgatatgtaaaaaaaattcatcttgacaggaaaggtaaagcaggaagtaattattcatgttacaaaagaattaaccacaggatcttttaaatagcaagctcccttagtgcacggaagaatatgactcaatttgcaaaatgtgattgacacttgacattttagtagcacctttgttgggctgggaacggtctatcatcataaaatgcaagctgagtggtcagttgatcaagtctttattgagcacctactgcatgtcatggatgcttataggggccccagcagaactaagggtgatccatacccagaaggcattcaggggctcacagggaagacaagacacagcttgggattgcctcagtggcaggggccagagaggccttgggtctagaagagcttggaaggtgatgtggaggcagtcaggacctagctgtggccagaaggcaaggaggctgtgcatgattacttaagtttaaagaaagggcaatggccagggtggtcgctcacgcctgtaatcccagcactttgggaggccaaggcaggcagaacatttgaagtcagcctgaccaacacggtgaaatcctgtctctacaaacaatacaaaaattagctgggcatggtggtgtgcacctgtagtcccagctacttgggaggctgaggtgggaggaacacttgagcctgggagacagaggttgcagtgagctgagatggtgccactgcactccagcctgggcaacagagccagaccctgtctaaaaaaaaaaaaaaaattttgttttttttttttagtatcttcttaattatgtatagattgtgtacatatattcctgtactaattgaagatcaagaaaaccccagagaagctcctacgctgttattattaggcttaacaaacttttgaaacacataaaattgagtattgtatgactttagacattggtggaaaaatgaagacattttcttcatggttcaggtacatagttttaaaatatcttgctaatcctgatggttccacacttacaccaatgtcaggggtggaaagaaacccatattatgaatgatcttgataactgagtgtttgggggccatctccccgtaagatctgatgtgtcttccccatgtggtgggcaaagagctcccagcagaagctgaagtggcaactctatcattttctttctttctttttttccttttctttttttcttttttttttttttttttttgagacaaagtttcgctcttttccccaggctggagtacagcggcatgatcttggctcaccgcaacctccgccttccggtttcaagcgattctcctgcctcagcctccagagtagctgggattacaagcacccaccaccaagcccagctaatttttgtatttttagtagagacagggcttcatcatgttggctaggtaggtctcaaactcctgaccttgtgatccgccggccttggcctcccaaagtgctgggattacaggcatgagccaccgtgcccggccagctctcccattttcttggcacttggcctcgtgttgtctacagctcctactttctttacacagatcttttcaagcagctgacccactttgtgagggtgatttcagcaagaaggggtcatagccataaggaggctgtaccaggaggcaccagagaactgcagggcaccccatggtggggacacagtcaaaccatatcagatgggaattattagctttgacatacaactgagacctagagaagttagcatcacatggaatgctggtgcttgctctggtggtactccttgattccactgtccctctggctgcttcctgccccttaaaggatccctgactgtgtgtcctggagactgggtgaaggaacctgtgtcattctgtcaatggaacaatagagaagttgaattattacttttttaaagttaaaacaaaatgaatagacattgtaatttttttctcccatcatctcaatggatgcttaaaacctatctcagtgtattgaagttggtttgttgttgttgttgttgttgttgttgttgttgttgttgttttactcatttgtgctttttgtctcctatttaagaaatctttgccaaacctaaggtcattaagattttctcctatccattcttataaaaagttttacaattttagctcttacacttaggtctgtgaactattttgagttaattttagcatatgcatgctttacagagctcatttaacttttcctcttccattattttatcataatttctgaattgctaatttaccactggggatttatctaatttttgctatccttgtattcattcatttgccattcattcattcattcatacggatctgcaaataaaaaaggaaaaggtggctgggcacggtggctcatgcctgtaattccagcactttgggaagccgaggcgggcagatcatctgaggtcaggagttcaagaccagcctggccaacatggtgaaaccccgtctctactaaaaatacaaaaattagctgggtggggtggcatgcattcaaggagaatcgcttgaacgtgggaggtggaggttgcagtaagctgagattgcgccactgcagtccagcctgggtgacagagtgagactccatctcaaaaaaaaaaaaaaaaaaaaaaaagtgttatgaaattggttcatattgaggtggtcatgaggagaagtccagtctaaatgaattgcataagttaactaatttttggattggttaatgctgctaatttgcattggcactttgtcagtgagaagacccacctttcttacctgttgcctttgctcattaccaagtatgagagattttcatagatcaggaaaacaatgtaacatggaattgatgcgtaagagctcatctgttgagagggcagttgtggttctgatgtaggcggtctgagacattggcttggccagccaggccctctatgccacctgtctttacacgtgttgttgctgcaagatgggtgttacctctgtcggatggtgtattagtctgttcttgtgctgctaataaagacatacccaagattgggtaatttataaaggaaagaggtttaattgactcagttcagtatggctggggaggcctcaggaaacttaacaatcatgacagaagggaaagcaaacacatccttcttcacatggtggcaggaaggagaaatgccaaacaaaagggggaaaagtcccttataaaaccatcagatctcatgagaactcactcactatcacaagaaaagcatgagagtaactgccctcatagttcaattacctcccactgggtccctcctacaacacttggggattatgggaactacaattcaaggtgagatttgggtggggacacagccaaaccatatcagatggggattattagctttgacattttgtacaactgagacccagagaggttagcatcacatagtattggcgggggatgggagacccagaagtcaaaccgacatctgttgtctgtactctgagctcggggagacaatgctggacaccctctgggtggggcaaatgttgttatctggctgtcatcatgcagcttcccctctgaagcgcctgctggccccaagacctgtaggccaccctgcctgtgcctgaccacggaccagcactttgtggtttctgtgctataggcttcaggttaaccaaaattgggttactgtgtgtggccctgttattttgaatatttgtagaggggaagtccctttaatgttactttactggccttcaagggatactggacctcagccttctccaacatctgacctaaattactctgttttccctgttccttccagtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagtgagtacaaagcaaaacccttttcctgtctcctgtgtgggctctgctgaccaaagtctatgggggcgcttgaggatgaattgcatgaactctcttagggaatggcttgccctcctctgtgatatcaagagaagcatgtatagttttgcccttggtatctgggatacttgttttgaaattgcttttttgaggctcaggatgatctctttccactgtgtatcacttcttaggatatgctaaggctgggtgcagtggctcatgcctgtaaatcccagcattctgggagactgaggtgggcggatcacttgaggtcggaagtttgagaccagcctggccaatatggtgaaaccccatctctactaaaaaaaaaatacaaaaattagccaggtgtggtggcatgtgcctgtagtcccagctactcgggaggctgaggcaggagaatcgtttgaacttgggaggcagaggttgcagtgagctgagattgcgccactgcactccagcctgggcaagagagcgagactgtctcaaaaaaaaaaaaaaaatagtaaaggctgttaaattgttgtatgtacttgtttatttgctttggaagtttaaaagaattttatttttttctattccttgcaaaatggaggtaaaactcagttttgaccacttaaataacaattaaattaaatgtagaattcagccagacatggtggctcatgcctataatcccagcactttgggaggttgaggcaggagagtcacttgagcccaggagtttgagaccagcctgggcaatatagggagatccctgtctctacaaaaataaaataaaataattagccaggcatggtggtgtgcacctgtattctcagctacttgggaggctgtggtgggaagatcacttgagcccaggaggttgagactgcaatgagccgtgatcatgccagagcactccctgtctctaaataaataaacaaacaaataagtaaaggtagaatccaaattatggaatgctttgaacgaatgaatgaatatagaattcaaattatgcaatgttttccacctttgtattcatattgcctttttttttttttttttgagacagtcttgctctgttgcccaggttggagtgcagtggcatgatcttgttctcagctcactgcaacctccacctcccaggttcaaatgattctcatgcctcagcctcccgagtagctgggattacaggcatgtgccaccacgcccgactaatttttgtatttttttttaagtagagatggggtttcaccatattggccaggctggtctcaaactcctgacctcaagtgatccgcccacctcagcctcccaaagtgctgggattacaggtgtgagccaccatgcccagctcatattgcctttttgataggagcaatattattttcctttacccctttatgtccatgaagcattaaacaagacttacttcttcagtaatgttttgaaaattatgccttttggagaagtcatctacaggttaattataaaaatgtaactcattcatattaataaattaccacacagttgtaagtagtactttgaattgttgggtagaaaaagatcacctggaggctattcctcatgggaaatattaactaggtctagaagtccccttgccataaactttctatctcatactggagaagaatggattgttctcagaagaatgggttgtcctcagtgggaagacctgcatgcagaagtccccaggtcccctgctgtagtctccgtgttaccagataatacttaagaggactgtgccttggatacagggaggcaggtagtatggggaaccttgggcccagagaagcaggtgacccccgccaaaggagccctgagggctgggtgggaggggttttttatgacaaggagttgttgatgaaaaatgtgtgatggacactggacttccagtcactaccctttcagagtcgaaaatgaataggaacctatttaaatctttctttaggatcttgtctcagggtgatcctgctagcatttctgttttcttttctctttggtgtgagaaggctggggagagttttgtagggaacatgctgctaaacattgctttctggagttgtaggaatataggctttccccccactgtactacacttgaatccagccgctcgctcccattttaagagtgggaaagtgctgcatctgggccaccacagactctgttgaggtgtgaatgggagttcttttgcatatcccaacaaagaccccagttttaggaaaggagcatccctgaagttgagctgcattctagtgtggaaagagggtttttccagataaaaggggcagtggttagagtgaagatgaaggaagaaggaatgacagaaggggactgtgggaaagagagaagaccctgggaaggagggaagactgtggggaaggatagcaagattgtgggaaagtgagcaggactgtggggaagagagaggagggccctgggaaggaaggaggactgtggaaaggcgaggtggatggtgggaaagagggaggaggaccctaggaaggaggactgtgggaaggggagaaggatcatgggaaagagagaggaggaccctgggaaggaaggagtactttgggaaggtgaggaggactgtgggaaagagggaggaggaccctgggaaggaaggaggactgtgggaaggggcggaagactgtgggaaagacagaggaggaccctgggaaggaaggaggactgtgggaaggggagaaagaccatgggaaagaggtagggggaccctgggaaggaaggaagaatgtgggaaggcaaggaggactgtgggaaggggagaaagaccatgggaaagaggtagggggaccctgggaaggaaggaagaatgtgggaaggcaagaaggactgtgggaaagagggaggagggccctgggaaggagggaggactgtgggaaggagaggaggaccgtgggaaggagaggaggaccatgggaaagagagaggaggagcctgggaaggagaagggactgcagcatcagctccagttttgagggtaggtcgtattttgaacacctttaatgtgtcttgttggcctagtgtcacctgattttaaaccacaaatctacagattcagagaactgagttggaaggcactgagaaagcctatggaatttgctcatagcatagggctggcgcgctgtcagtgactgtggagggaaccagggcagggaaatgcagtgtaggaactgcccacgcgagagctggaacctgaccctccccctgctcggagaggactccttgctgtgaaatggaggtgatgtcttgaccagaaggtctccgcattgccccacctgctctgctttgggctaggccagtgtgggcatggcagcaggctcctgtcctgtggcttcccatgggctttggctcaagggaagccctggtgggagatggcagggagggatgcgagtgagattggggggcggggggaggcggttatcccaccaactccctgctcatgtggattttgggctggccgtgtctctcatgggatgggtggctgctccagtcaggctcaccttcctccttacccctctctcctcattccttcaggtctgggggcttccttgtttcgagtccctggctaccaccttgggctttctttatacctcacccaccctgtgaaagagtattaatcccacttgagattaccctaattcgagtgggccatctgtttccttttgagaacccgactacctcatcggcctgttcagaggattaaaccagagaatgctggaaattgtttagcacagtggccagcccctcagtgagtgtgccacagtgctggtcactgggtgagggaatgggtcctctcctctgggcctgaattgccctgcgctcacctgctcaggtgtcctctagtttcagccggagcacttccagggaggggaagacatgctcttgagagatgcttgctctacctagggcagaaaggatgtagcaggagtggctggggctgcgctacttgtagctgtcacatttggcagaaaaagaaacttctattctttcagatggctgagtctattttcaagtcttcacccactggaaatgttttaggcctattattgaaaattcagtaggtggttgcagtggagttaaacaataaccaggactctgtagagaattctaaaagctgaaaatgcatctttaagtaatagtaatcatattggcataggtgtgcacttttgaaagtggctttatgcatgtcctatgtagtgtaagaataatgtgtccccagatggaattgggtagttttgtggaatgtctttctttttttttttttgggatggagttttacccttgttgttgaggctggagtgcaatggtgtgatctcggctcaccgcaacctccacctcctgggttcaagtgattttcctgcctcagcctcccgagtagctgtgattacaggcatgtgccaccacgcctggctgattttgtatttttagtagagacggggtttctccatgttggtcaggctggtctcgaactccctacctcaggtgatccgtctgcctcggcctcccaaagtgctgggattacaggtgtgagccaccacacccggtcaggaatcccatttttatacccacatgcctttctgtccatgttaccactgtcagagagcctaccttaagcattttcttttctttttttttttttttttgagatgggttgcactctgttgcccaggctggagtgcagtggcatgttcacagcttactgtagtgtcgatctaggctcaagtgatcctcccacctcagcctcctgactagctgggactataggtgcacaccaccacacatggctaatttttgtatttttagtggagatggggttttgctatattgcccaggctggtcttgaacttctggcctcaagtgatcctcccgcctcggcctcccagaatactgggattacaggcgtgagccaccatgccctgccaaacattttcttgattcatttagcagatccttattcagtatcccatttgagcgtggtcctccagagtgttgggattcgtatccaccttcatctcagtgctgtctcagtctctcaagagaaaaataccagccattcccctggtatactgagtagcaggccatcccattgttaagaagatacctgtgctttgtcagctcttgggctatttttcattatgcagaaatgtacccagctaggccacatgcctttttaggtttgtctctcttttatttagtttgtccttatttatttattgtaaatatggaagaagaatcttttaaaatctcccttctctttcttttctttctctctctccccacccatgtctttttttgagacagggtctcattctgtcacgtaggctggagtgcagtggcgtgatcacggcttactgtagcctcaaactcctgggctcaagcaattctcccacctcagcctcctgagtagttgagaccacaggtgtgagccaccacacctggctaattaaaaaaaaaaaaattatgtagagacagggtctcactatgttgcctaggctggtcttgaactcctgggctcaagcagtcctctcactttggcctcctaaagtgttgggattataggcatgagccactatgcctggcccccacccacttattttggaatacatttttctttatccctcccctttacaaaagtattcatttttaaggtgaaatttatgtagagtaaaatgcataagtcatatgtctatggcttgatgatttttttttttttgtttctacgtaagtgcgtacctctataaccaccacccagatcaatgctatttctatccctctagaaagttccagcatgcctataaaaaggaagggggaaatgtcagagtcgttggaaccagagcaactgcatcttgaataggggttaggtaaaataaggctgagacctactgggctgcattcctagacagttaggcattctaagtcacaggacgagataggaggtcagcacgagatacagatcataaagaccttgctgataaaacaggttgcagtaaagaagccggctaaaacccaccaaaaacaagatggtgatgagagtgacctctggtcatcctcactgctacactcccaacggtgccatgacagttgacagatgccatggtaatgacaggaagttaccctatactgtctaaaaaggggaggaactcgcagttccgggaattgcccacccctttcttggaaagctcatgaataatccaccccttgtttggcatataatccagaaataaccataaaaatgggcaaccagcagctccaggcagctctcggggctgctctgcctgtggagtagccattcttttattcctttactttcttcttcttcttttttttttttttttgagacggagtgcagtggggagatctcggctcactacgacctctgcctcccgggttcaagggattctcttgcttcagcctcccgagtagctgggactacaggtgcgtgccaccatgcccagctaatttttgtatttttagtagagacagggtttcacatgttggccaggacgatctcaatctcttgaccttgtgatccgcctgcctcggcctcccaaattgctgggattacaggcatgagccactgcgcccagcccctttactttcttaataaatttgctttcattaaagaaaaaaaaaaaaagaacagacagttccaccaagccttttcccaatgattcctctccccctaggaaattgatcatcatacattagttttgcctgtactagaattttgtataaatggagtcatacaatatatgttcttttatatatgactggtgcacaacaaaatgtttttgcgtacatcggtactttgttcttgctgtgtagtatcccattatgatgaatatcccataatttgtttaatattttgttgatggatatttgggttgtttccagtttgaggattttattgatagaggctctgaacattcttgtatgttgtcttatggacattagcactaattgctcttgcatatgcacacatgtaagagtggaattgctgctgtcactgactttcaacctgtagatttttctctgtgtaaagttgtggcttccattgggtgaggggaggaggtgccatacctgtgcctgaagcctcatttgcgccacactagtcaatttagctaatcagcctgaatcttgtcataatgtagccacctatgaatataactggtgaggcgtcctgatgcacagaacccaatctcccagtgatgatttgattattgggccccaggaactgacaaagactgatttttaatttatttttttattttttttagacagtcttgctctgccacccaggctggagtgcaggggtgggatcatagctcactgtagcttcaaactcctgggctcaagtgatcctcttgccacagcctcccaagtagctaggaccacaggtatatgccacctcacctgggtaattattttgtattttttgtatagacggggtttcaccatattgcccaggctggtctccaactcctgcgctcaagtgatccgcccgcctcagcctcccaaagtgctgggattacaggcgtgggccaccgtgcctgggcgggtcttgctatgttgttcagctggtcttgaactcctgggctcaagtgatcctcccgccttggcctgcccaagtgttgggattacaagtatgagccactatgccaggcctattatattgttaaaaacatacaaagaacatgtgtcaaagtttcgttgaacttatttaatgagggaactagcagaataacaaaacaagctcagtgaggatatgaggaactcagtggaaaaaaaaaaaacctcagtggaaaaaggaatgttcaaataagattgctaagttaggttcaaaactggttcatgtcttagagaacaataaaatctttacctttggggttatcatctctaccagaaaagaaaaaagagaaaacagcataccttatcatttttctacattatcttctgacttttataggattgtaaaatatcctagtagtgttagttaaatcaagttacattttcagagtcaggtgaccctcctggcgggggatgggggggagtgtttattaaaaatgcaatagcatgacattaaaaggtcacatgatcatcttttttgcctagtttctaagttttgggttttttgtttgtttgtttgtttgtttgtttgtttgtttttttgtttaacagaccatgacagaccataatatggggtacaataataggaaaaactaggatgatatcttaaagtcatttaatgaaaaaaaaaaaaaaaaaaaaaaaaaagactgcacttctgggacctcagactgctacctaaaacagaaagccagtcacctatttcaggtagatgtggactctttcacaggggttaattttcccatgttggatttaactaccagtatcttccttttaaaaccttaccctcagatccagacaacattgttctttagtcaagcaaagcatgtataagcagccttttcttctgagttctcctggaagggacccacagctattcattttcaaatgaattttaaaagaaaaaaagccttgaaactatagctcgggctgatgtgcatgtgtctgcctgctcttttaggggacatttgtctgttaggggacatttgataaagttcaacaggacacaggccctcaacattttgtagctcacagatagacatgtggaaggcaggaagctatgataggggttaaaagaatatgcttgttgatctttaaatttatctgactctgtctgtgaggaagtaagctgttttctctgcctgtttttgtatgtgttcggcaaaagtacattttcccctctgcctgcccaattgttgatgggtgaagtgtgtacacttgcagcttgcatgtcctatgtgtgctgagcataaccattctcagctcacttgccgtggcctcagctttcatttgctaggtgttttagatctctctttggcacatttagagcccattttgatatttgtttaaagtggttggtgaatgtggctgttcttttttgatccatgaggcgaaaggccagtattttgcctaattgtaccactccaagataaagctcacagttactttgttcttcttgatttatgaagggatcacaaatctacttcaacaagtgtcataaagtagagattttcaggttactgttctacattcaaagaccctgacatggacctctttaatcatatttcacttttctttaaactttaaactcaagggccattaattttgtgaattatatggatgattgttttcaagatgtttgtctctcttcacaaggtagcagtaatttttctgggtgtgttatgttatgttatgttatgttatgttatgttatgttatgttatgttatgttatgttatgttatttagagacagtgtctccttccatagcctaggctggagtgtagtggtatgatcatggctcactgcagcctcaacctcccaggctcaggtgattctaccacctcagcctcccgagtaactgggactatacacatgtaaccacctaacctgttttttttttttaaattttttgtagagatgggggtatcactatgttgcccacgctggttgccctcctgggctcaagtgatcctttcgctttggcctcccaaaatgccagggttataggcaggagccaccgtgccctgtccaggtatgtattataatgtgcagagcctcatcttgctcacaacatttagtcctggtgtccttgggcatgtgggcatctgctgtgtgttaggcaccagaggatataaactcaaatgagatggactgaatggaatattgtcacaaatgtaacttctagaggatgatagttttagctcctatgacctgcctttgggaattctgtgctttaaacattgttctacaaagatattctgtaaagatgttctggattaaaatgccacttgagaagtttctggctgaattcatccagcaactgttagaatgtgctaaatgaacctacagttagctttttggccctgatggctgtgttactttatggagtaataatggctgcattctattcaaggcttactggctgcctggcattgtatgtataatctacccatgtctgtctgtgtacagtgactaaaatttgttgagcccttactgtatgccaggtaggaaggaggccaagccctttccatgtttttttgtttgtttgttttttgagattgagtctcactctgtcacccaggctggaatgcagtggtgcaatctgggctcattgcaacctccacctcccaggttcaaacagctctcgtgcctcagcctctggagtagctgggattacaggcgtgcaccaccacgcctggctgatatttgtatttttagtagagatagggttttgccatcttggccagtctggtctcaaattcctggtctcaagcaatccacctgcctcagcctcccaaagtgccgggactacaggcatgaaccaccgtgcccagcccctttccatgcttttttatctcatcaaattcttctaccactctatgacaggtaactgaggcatatcagtgttaaaagccatactcacagtcacacaaactagtgaggagcaaagagagcattagaatctaggccaaccagctctgcaacctgagctcaagcgggcagcattatctgggtgtctgaattgtcctgacaggactgtgctcctcaccattattgtctgctgtattatgccttccccaagtgtccattcaggtggaatcatggtatttaacttatttctgtctgcattttaaataattctcttcaaaagttggccctttcaactcaaaagaacaacctttgcctggatttatgggcttgtgttgttttttcctacaaattctgaaattaaggcaattagggaaaatatttcgttattattaatttgtaagcacacgttgttttgcagtgttcagcaggctatgctttctaggagtttgactgtcttttctatcagtggtaaataatcaagatgtgtgactatccaattgttccccatccacggggccctcaaaaccaaccaattccagctcaaattattcttgaaactttaaacatacagttttctttcagaaaaacaatttctaaaactaacaactggaacctgttagattctgttgtgagaaatgttattccaagtagggtctggagtaattaagtacaagtgtgttaccaataagaacccacatcatttggtggtttcttcaggctttgtaactgttgtagtgcagaaaatgtggtggaggggggcggtcttgtgactcagggagagctgtgacctcagtgagttttaatcgcctgactgagttgatcgtggtgattatgcataatggaatcttattttcttaatggcaagattatcgaatcttagcttggaaagggactttaagatcatgtgttttaacccttagctttctaccagatcaaaatctaaaccatctgagatatcaccgtgatcattactggatatttaaacttgttaagcttggggctcccacagcgactccatgtcagtgtgtctctaacctggtcctgctccaggtgcactacgtcatcagaattttgttttgggggcaggagtagggatagaagccttagaatcttttaaaaagttcaggtgattctgctgcttgatctaaagcttgggcattcattttgcacaatggtaccgatagggcagtaccatgtttttaattctagtttcttttctcaagaacatgaattggtagctggtgacttcaattagaaaatattttcatcttatttctaaagtagctttatggataaagtattaatagctatattagtgaatatgtaagtaaacacaatcatgctggaaattattgtaaaagtttactacaaatacacaaagaacatagtgctatgtaaacagtgcttgatttaagtccattagaattaatacattctggctgggtgtggtggctaacacctgtaatcccaggactttgggaggccaaggcgggcgaatcacttgaggtcagaagttcgagaccagactggccaacatgatgaaacctgtctctactaaaaatacaaaaagtagccaggcgtggtggtccatgcctgtagtcccagctactcagaggctgaggcacaaaaatcgcttgaacctgggaggcagaggttgcagtgagccgagattgtggcactgcactccagcctgggcaacagagtgagactatctcaaaaaacaaaaaaaaccaaagagaattaatacattctaattgcggaacttctgtactcagtgattctccatcccactctatacctggtggtagtgagataggcacaatttctagcaatggtcctcaagattctactcttaagtccccacaacttctacatgtgatgagctatcactccagtgattttgttatgttatatggcacaattgatctttaaacagggaggtgatccaggtgggcctaacatgagtccttaagagcagagaactttctcctgtctagtggcagaagagaaagtcagaggaggacttgctgctttgaagagggaggggtcatgtaagaaggaaatgggcagcctataggagcagagagtagaccttggctggcagccaggaaagaaatggagacctcagacctacggccgcaaggtgctggattgtgccaacaacctgagtgaatttggaagtgggttattcttccaagccgccagataaaagtctagcctattcacatcttgatattggcctgtgagaccttgagtgaacaaagaatccagttgagcctatcgggacttttgacctacagaactgtgagataaaaaatgggtgtcgttttagataacccatggcagcattccctcctctgctggaatgtcgtcagtggagactgactggggattctggacttccatccccatcctcccactcagcagtggtaggcagctccccctccccactagagaatggggaaaatcttggagaggagggagctgaagaaaggaattaattaaaggaatattccctgcctgcattggaagtcctgggcaaacaactcctaacccacctgcatgtgaatctgactagaacaaacatgccaaaaagtttagcaatagaaactttaacacagaatatcacccaggttttcagaatgacctctaagtaacagagatgaagcagaccagaatagtactgcaagggctctgaaatcaaactatcgttaaaactgcagccaacgaaaatagcccaggatgtgcgtacttagcctcaatagggttaatgccagctaaaatttaaatagtatctagagtcttgtaagataataacccaagtgcccaaggtacaatttaaacaatcacttgtcataccaagaaccaggaaaatcacaactcgaatgagaaaagccaatcaacagatattaatactgagaagactcagatgttggaattatctgacaaaggttttaaagcatctgtcataaaattgccttaataagcaattccaaacactcttgaaacaaatgaaaaattagaaaatctcagcaaatcaataggttttttaaaaatggaagttattgaaccaaaaaataaacaagttaaaaagctcaccagatgagctcaataatagatgacagaggaaagaatcagtgaacttgaaaatagatcaatgaaacttacttagtctgaacaacagatagaaaatagtctgtaaaaaatgaacagagccttagaggcctatgggataataacatcagatctaacatttgggtcatcagaattccagaaggagaaaagaaggttatgataataaacaatattgaacgaaatgatgactgaaaactcaccacatttggcaaaaagcataaatcttcagaattcagaagctgagcaaaacctaaacaggataaacctagagaaatctatgccaagatacatactaatcaagcttctaaaaatgaaaggcaaagaaaatgcagcaagagagacatgacatatacttacaaggaagaatgatttgaatgacaatgaatttctcctgtaaaataatggagtccagaaggaagtgtacaacattttcatgggctgaaagaaaagaaagattaactctgaattctttgtctggtgaaaatatccttaaggaatgaagagaaaatgaaaacattctcagatgaaggaacactaagagaatttatcaatagcagacctatccttaaataatgcctaaagaaagttttttaggctgggcacggtggctcacgccggtaatcccagcactttgggaggttgagatgggcggatcacaaggtcaggagatggagaccatcctggctaacacggtgaaaccccatctctactaaaaatacaaaaaaattagccaggcatagtggcggccgcctgtagtcccagctactcgggaggctgaggcaggagaatggcgtgaacctgggagggggagcttgcagtgatccgagatcatgccactgcactccagcctgggcgacagagtgagactccatctcagaaaaaaaaaagttttttaaacataaaagaaatggtaacagaagaaactttggaatttcagaaaggagaaaatagcaaatgggtaaaaatagggagtatgtatagtaggccaagtatagggtatgtgtcattaatttttttctgttgttgttgttgagacggaatcttgctctgttgtccaggctggagtgtagtggcacattcttggctcactgcaatctctgcctctcaggttcaagtgattatcttgcctcagtctcctgagtagctgggattacagatgtgcaccaccatgcctggctaatttttgtatttttagtagagacggggtttcaccatgatggccaggctggtgtcaaactcctggcatcaggtaatccacccgccttggcctcccaaagtgctgggattacaggtgtgagccactgtgcccggcttgtatcattaatttttaaaaacatgtttgatggttgaagcaaaaattagatcatctggtgtggtatccaatatatattgaggtaatatgcaagaaaattatatttaagaggtggggaggatgtaaaagaacctaactggaagtaaggtttttacacttcactgaaataggaaaatgttgatcgaagtagtctgtgacaagttacatatgtatattgtaataactaaaatactctaaaaatcactaaaagtataactgtacaaagagatatactaaaactgcctatatataaaaggaaattctaaagaatgtacaagtaacccacaggaagacaagaaaaaggaaacaatgaaaaacagagtgaacaaacagaaaacaaataatacaatggcaggtgtaagtcctaacatgtcaatatgtgttttaaatataccaattaaaaaacagagatgatagataaaaaaaaaaacttgactcaactatatgctgtttgtaagaaactcacttcaaatatattgatataggcacgttggaagtaaaagttggaaaatacatactatgcaagtattaattttaaaaaagcaggagtggctacatataatatcagatagggtagaccagagagcaaagaaaattaccagggacaaagaaggacattacacaatgataaaagtgtcattccaccaagaagacgtagcagtcctaaatgtgtatgggccaagcaacagagctgcaacatatatggagcaaaaactgatagaactagaaaatagacaagtacacagttatagttggcaacttagcatctctttctcagcacttgacagaattactaaacagaaaatcagcaagggtatagaaggcctgaacaacataatcaaccaagaagttgtaattgatgtttacagaatatcctacacagaaacagcacaaaacacatttttttcaagtacccatgaaatatctgccaagttaaaccatatcctgggtcataaaactaacctcaatatatttaagggaattgagataataaaaaaggtgttctttgaccataagtaattaagctagaagtcagtaatggaaagatcagaaaatctccaaacacttggaaatcaaatcacacacttctaaataatccacaggtcaaagaagaagtctcaaaaagattaaacaaacacatagaactgaatgaaaatgaacatacaacatattaaaatgtgtgggacccagctaaagcagtactgagaggaaaatttatagcactaaagtttacattagaatggaggaatgttctcagatcaataatctaaggtcctacctcaagaaactagaaaaagtgaaataaaccgaaaacaaccagaagaaggaaataatgaagataagagcagtaatcattgaaggtgaaaacagaaaaacaacagagaatatcaatgaaaaagccagttctttaaagaccaataggctgggtacagtggctcatgtttgaaatcccagcattttgggaagcgggagtgggaggatcacttgagcccaggactttgagaccagcctgggcagcatagcaagacactatctcgccaatcaaaaaataataataataatcaaaaaattagctggacgtggtggtgcatgcctgtggtcccagctactcaaaaggctgaggtgggaggattacttaagcctgggaggttgaggctgcagtgagctgtgattgtgccactgcactccagcctgggtgacagaatatgatcctatttcaaaataaataaataaaaagatcaataaaatgggtaaacctctaagaagacaggcaaagatgaaaaagacacaaattagcatagtaggaataaaacaggtgatatcattacagattctgcagctattaaagggacaataagcgaatactaaattatatgtacatacatttgacaacttagatgaaatgaaccaattccctgaaaactacaaactaccaaaacttacccaaagtgaaataatgtcaatagtcctataactaactgttaaagaaattgaatttgtcatgtaaaagcttccaaaaaagaaatctccaggcctagaggtttttcgtcataatttccaccaaacatttaaagaattagcaccaattctgcataatcttttcgagaaaatagaagaggagggaatgtgtcccaattcattttatgaggccagtattaccttaataccaaaaccagatagtgcaacaaagaaaactgcaggccagtgtccctcaagaacatagacacaaaagtcctcagcaaagtattagcaaaacaatccagcaacttataaaaaaaattatatactatgaccaagtggggtttattccagatgtgcaaggccacttcagtgtttggaaatcaatcagtgtaatccatgatatcaacacgctatgggagaaaaaatcaaatcgcataatcagatcaattgatgaaaaaaattgacaaaattcaacgccattcatgataaaaactctcagcaaactaggaatagagaggaattcccccaacttgataaagagcatctacaaaaatgctgcagttagcaccatatttaatggtgaaagactgtatactctccccctgagaatggggaaataaggtaagaatgtctgctcttaccagtctcattcaacgtaatactggaagtcctagctagagcaactagttgagaaaaaaataaaagacatatgaattggaaaggaagaataacatcttatttgcagatgacgtgattctccagtagaacatcccaagaatttaccaagtaactcctagaataagtgagtgcagtaaggtcacaggatataagatcaaacacacaatttaatatttctagatactagcaatgaacatatggaaactgaaattaaaaacacaatgccatgtacagtctctcccaaaagaattgaaatacagttatgcattgctgaacaacagggatatgttctcagaaatgcattgtaaggtgattttgttgttgtgtgaacatcatagagtagtatacttatacaaacgtaggtgatatagcctactacacacctagccatattgtatggcctatcactcctaggctacaaacctgcacagcatgttactgtaggcagttacgacacaatggtaagtagttgcatatctaaacatatctaaatattggctgggcactgtggctcacacctgtaatcccagcattttgggaggccaaggtgggtggatcacttgaggtgaggagttcgagaccagcctggccaacatggtgaaaccctgtctctactaaaaatacaaaaatgagctgggcatggttgcctgtgcctgtaatcccagcaactcaggaggctgaggcacgataatcgcttgaacctgggagacggaggttgcagtgagctgagatctcaccactgtactccagcctgggcaacagagcaatactgtctcaaaaaaacaaaaacaaaaccatatataaatataaaaaatgtacttaatacaatagaagtatggtattataatcttatggggaccattgacgtatatgttgtctattattgacaaaaacaatgttatgtagcatatgactatacttaggtataaacttaacatgtacaggatgtgcatgctgaaaacaacaaaatgttgttaatagtattcaaagaagatctaaataaatggagagacataccatattcatggactggagtcagtgtggttaagatgttgattcccccaaattaacctgtagatctaatgcaatttctatcaaaattccagcaagatttttttttgtagctatagactagtttattttaagatttataaaagaaatcaggagaactacaatagtcaaaacattttgaaaacaattttgaaaaagaagagcaaaataggaatctacccaattttatgagttaactttaatagttatagtaatcaagacagtctagtattgacacaggaatacacatatagataaaggaacggactagagaacccagaaataaacctacacaaatatgcccaagtgactttttgacaaaagggcaaaagcaattcaatggaggaaggatagccttttcaacaaatgatactggagtatttggacatccatagacaaaaaaagtgaaactcggcctaaatctaacatcttattaaaaaattaactcaaaacggatcatggatttaaatgtaaaacataaaactataaaagtgttagaattaaacataggcaaacattttggggacctaggcctaggtgaagagttcttagatatcataccaaaaacaaaatcttttttgtttttgctccgttgcccaggctagagtgcagtggcacagtctcagctcactgcagcctcgacctcccaggctcaagtgctccttgtgcctcagcctcccaagtagctggaactacaggtgtgagccaccacgcctggctaattttttgtattttttgtagagatggagtctccctatgttgcccaggctggtctcaaactcctagactcaagtaatccactgccttggcctcccaaagtactgggattacaagtgtgagccaccacacctggccaacacaatctattaaataaaaaaagatcaattagacttcatcaaaatgtgaagaggatgaaaagataggttacagactgggaggaaatatttgcaaaccacatgtctgacaaaggacttgtatctagaatgtgtagagctctcaaaatgcaacagtaagaaaccaaaacaatctaatgaaaatgggtgaaatacacgaacagacattcactgaagagagtatgcagatgtaaaataagcacatgaaaagatgtccaacatcattagtcattagaggaatgcaaattaaaaccacaacaagaaattactatgtatctattagaatggccattaggatggctaaattaaaaatggtgataacaccaaatgctggcaaggttgcagagaaactggttctctcatatattgatggtgggaatgaaaagtggttcagtcagtttggaaaatagtttggcagtttgttatagaactatgtgcttcccataggatgcagcagttatacttttggacactcatcccagagaaataaaaacttaagttcacagaaaaacctgtacacagatgttcatagcagctttatttgtaataattgcaaattggaaatatcttgaattgtctttgagtggatgaatggttaaacaagttccggtccaaccataccatggaatactactcagcaataaaacagaatgaactcggatacacacaacaacttagatagatctcaggggcatcgtgctgtgtgaacaaagccaacctaagatgttacacactgtatgatttcatttatattacattctcaaaatgacaaagctatagacttggagagcagattactggatgccaagggacaatgacagggtgtggggaagactggtaccacaataaaggggtagcatgagggagttccttttgaagatggaatagttctgtatcttgactgtatattgattgtgatccagtgtgtagatttgtgcaaatctacacattggatcaagttgcaaagagttacacacaaatcagtgtatggaatgactgatgaaaacggaataaggtctgtagtgaacagtattgtaccaatgtcaatttttttgttttgatattgtactatagtcatatatcatcactgagggaagctaagtgaagggtttatgggactccatgcaccgtttttgtaagttcttgtgagtagataattacttcaaaataaaaattaaaaaaaatctccaatgggtctcaaccttggcagcacacaagtatcgcccaaggagctttaaaaatcccgatgcccaggctgcatcttagtctcatctttatctctgattgtgagtctcagcattagtattttttaggatttctaactcttgtccttgttgttttccattaaattaaaaaaataataaccaccaccaggaccataccactttcccatacactgcagttctccagctctttgtgggtgatgggtgatgggtgacagattacaggtgtttcagttctttctcaggaggtcagactctgtcatcctgttgtcatgtctgaggctgggatttggggaagccccacccccagctttgagcaggtccaaggaggcattatcacttggcctgtctgtggttggcctggagactggagggccaatgacagaagtagagttgggaggagaaaagaaggatggaggaagagagaagtgggggtggagtgtgagaggatgtgggcctcagagaccctgttgagcctcaccctgggcctagtctcttggagcaagcatgtttgaggaggagaaagaaggggaggggaagatgaatgttggggatgggattgcaatttatgatagggaggccaggaaaggcctcatgaaaaaggtgatttaagtcaagacttgaggatgtgaggaagaactttgtggggatctgggggaaagagcccttcgggcagtgggaacggcacgtgcaaaggccctatggaggagggtgtccctggcttgttggaggaacaacagagagaccagtgcaccaccactgccggagggaagagggcaggggagagcaataggagaaggggttagaggacataggttacagggctccagatcagggagggccttgtgacttgtgactctgagtgagatgggaagtaactggggaggctgatgcgaccagagatgttttaacaggttccctctggctgccgtgttgagaaaagactgcaagggggaagggtggaagcgaggagagcagtttggaggccctttgcaggaatacaggggagaccagggggtggcagtgggagggtgagaagtggtcagattctggatatttctgtaagtacagccaacgggatttgctggtaagactgggggtgtggcaggagaggaaggagggagagatgactctaaggtttttgtcctgtgcattgggaagcatggtagggatgtgggtctggagtgtgggggccaggtccaggctagagataggaatttgcacagctgcccggctgtcagcccaggcccaccacagaaccacctctggcactacaattcctgtttgatgcaaggatggctgcttttcttacctgtcaccctgtgatgtgaaatcatgcatttagagcaacttggtaaatattaatttgtcaacaaatattagctattaatatcagtattaagccactccaagacactggagaaatacttagatggtgtttagcagtttggtactgtaggattcggatgctgagatggagttaggagtagaggaggtttgtttgggggctggggggataacacccttgaaggatgagagagcagaggagcagggcagggagagcctcaggtggtgatgccagtctgtcctggccagcctaacagggggcttctggacaaaaattgctccatgaaagcaaaggggagatgctagccaaagggcacaaacttgcaattacaagacgagttctggagacctgctgtgcagcacggtaactagagttaataatcatgcattacatacttaaaatttgagagtaactcttgcgtgttcttattacaaaaagggaactctgtgaggtgatgagtctcttaattagcttgattgtgatcgtcatttcacggtgtatatatatgtcagatcatcatgttgtacaccttatattaatacaatttttctttgtcaatcatacctcagtaaggctggaaaaaaaaaaaaagaaatgggcagaaatggccaggctctaggactgcactccccagattagtgaccagctgttggctcctcagcgagagcatggcctctgctagaaagaaagctgaggcagattccaaaggtgcaagttagttctttccttcttcttcttcttcttcttcttcttctttttttttgtttgtttttggagacagggtctcactctgttgcccaggctggagtgcagtggcgcgatcatggctcactgcagcctcgacctccaaggctcaagtgatcctcccacctcagcctcctgagtagttgggactacaggcgcgtaccaccacatctagctaattttttgttgttgtcttttgagacagagtctctctctttcacccaggctggagtgcagtggtgcgattttggctcacagcaacctccgcctcccgggctcaagcgattctccttcctcagcctcctgagtatctgggactacaggcgtgcactaacacacctggctaatttttgtattgtttgtagagacaaggtttcaccatgttgcccaagctggtcttgaattcctgagctcaggtgatccgcccaccttgtcttcccaatgtgctgggattacaggtatgagccaccatgcccagccccagctattttttttttttttttttttgtagagacggggtctcactatgttgcccaggctggtctcaaactcctgggctcaagcaatcctcctgcctcagcctcccaatgtgctgggattacaggtgtgagccactatgctggccaagttctttcttgaaggaacatatgggcagtacatctttagggctacccagaagacattttgtttcactttagcttcttaactcacaaagggatatgaaatagtatattgccccactcgcaggctaaggggtaaatttcatcatctttatgccactgagggagatgagataaattcttgaggagagttcagggagagtgaaggtgaagatgtgaaagtctctttaatgtgtagtcacaacatgtactagcacaaaagtcacacaaacacacagttatttgtggaatgaggtgtatgaagtcagcccgtttttgctcttagctgtctattttgctcgtcatgaaggagagcttttcattattgtcatacttcctctgggaccaccaggattttctcatgaagactaacaaagagatgatatcatgtgtctgggagtcagggtgaaaaacaaagtgggcttgcctgagtttgtaagctgagaagttgtccgagtcaaaccacatcctgccctgggtttctagaggcaggtggtcccagatggagacccagagcgggaggaactgtgccaatgctttcctaagagccatgctcagttcccaggaggtgtgggggaggccctggtgactatgtcctctttacactgaagttttcttctagggaggccacaactcactggttgccagtaaaggttgtgaagttggttccagttccagttgtggctgtgctgtgaaccagctgtgccactggtggccatgctgaagctcttggggttgtacttttcctggctgtcaaacgaagccatggtcaaggtctgagatagctagtgcaggtaggtagtatcggcgcagtgggggccaagtcaaaaccaaagagggactgtttttgcgtatcatggaagaaaaagtaaattaacattaaaaccatgtttaaaatatttattagatgtacattttagttgtgattatactacaacataattggaattgatgaagtattaacatgtgaacatattcttagcaaagctggacatgtttggagagtaccttgtcaagagtgtgatgcctgctgccgaaggcttcggtccagtgggatttgctttctgaccagataagattttatctaagagacaacatccaaaatcaataggctgacagattattggtaaaagatacattacagctgtttaaaaccataaacgctatcaagttctaactgctaagcctgtagtcatattgtaatatcgggaccctcatgggcacagatatgaaaggaatcaggatggtagctgtcgttctgtaattgctgtttaacagcctggcttatattcatgattcaatctttttttgtttttttcttgcttccacaattcaatccttatttctgtaagctgcaaaatcgtgagtgtgcgcacaagtttttttctcccccggtcttgaaactggaataattgccaatctgcttattaaaaaaatacatctgccctatgaaagtagtttcagctactctgtgttaaatgagtgattatgacattgggctctggtggcacgtaatactaatgctgaaacgcttgaatatggaggttagtgtggtttcagatgttgagaaatcacttctttgtgcttattgacatttttccaaggactgctctgttatttggcttaaaatgtcacatgacagctgatctctttggtgcatataatccatgcaattatagtgtgagcttctgctgtcagtggtggttaaaaatccatatacctcactccttttttagcctctgattttttttaattcaatttaactcatccttttattttaaaacttgaatttgaatgggttccattaacagatattttaaggtgacaatcaagtctagggcgctgccagcttgaagctgaacacagtccctagccctcaagctggatgtgagatctaatttagggcatgttgcaatgcagagatgtagctgatttgtaaacagcccttgtgacaacgtaatacagttgacaagtgatggttctcaggcagggtgaagtgtgttatctagctgtctgagtgatcaccctgattgcagttccacctggggttcatctcacagagccacacaggataattaaagccacagattcatcattggtagattcagcccattttagtctcattacagacaaatttagtcctgtcttcattcattataatgaaagtcacacgaagattcactttactataaactatattctttttcccttttaaatggaacgtacaagtgaatgttaaagtataaaagtacttgcaagtcactcgctttgctaatgagaatgtatgcaaatgtggtgcatgtttgcctttcctggactcagccctgtgacccatccctgtgtctgtcctgatggcagggattggtagataacttatgttggcccatctcttcccagagtggctagaatggtcttacggacatagaaggacatgttaaatattcatctggtttaattgaatttaatacacaatccttaagattaatctgcacttctggagttattaaatggctcactttttagtagcatatcatttatttgctattatctgagatagtgaattatttaagtaaaaagggaatgttctttccatgaggtggatcttaccaagctgctgctgctttcatttacaggcgattaccaattatattaaattaggaatgtgggtaaaaggaagcatggccgtctgaaggtttaagatgtttggttactaggtgttgcataatgtactgcaatctgggatctggcacttgctggttgacctatggtctgctggcacatgcattattaattatcgttttccatgaatattaatgatggttggatatcagtttaaagaatagtgaatcaattaacatgtaattttcatatactttgatttataaacatgcacattttaagatacatttgttttcttttagaacattaatttttccatttcagtttctcctttcccttgatactgactttttttttctttctttctttttttgagacaagtcttgctctgtcgccaggctggagtgcagtggtgcgatctcggctcactgcaacctccgcctcccgggttcaagtgattctcctgcctcagcctcccgagtagctgggattacaggtgcacgccaccacacccagctaattttttgtattttagtagagacagggtttcaccatgttggccaggatggtcttgatctcctgacctcgtgatctgcctgcctcggcctcccaaagtgtggggattacaggcgtgagctaccgtgcctggctgatactgacatttaatggtgtattggagtgatttatattttttcaggacaatttctgaagcgttgccaaaaatgctggttgtattttaaaattcaggtgatttctgtaagttattgaacaagaaccaagtgctgtacacatacctcagtctatttatattatagtactcttttctaccatggccacctacaacttaattttataatttgaaatgttactgaaccatgaaaatataaaagagcatataaccaacatctagctacccactacctagttctatcaaatgttgccattttgtcatacttacttctgatccttaaaaaaataaataagtagacttctgatttcagctcagagatgtagagagctgcaaagatgtccctcccacgcttccaagaaaaaatctggacagattggaaattaacagagaactgagtttgcagagcaaacgaccatttcaaaatctggaaagaggtgccttctgagacacaggacaggacctgagcatttgtttacaggagcagaagccaccagaccccatagaagtaggtaggaagattaagctagaaaatttgacaaattgctggaggctgagtgtgggctaacttgagagtgtgaagtcttgagggcagcagttgtgggggagggggtcctatccctttgcaggcttttcttccaggaaccccatttggctctaactgggagggtgagggaaaattcagagaaaactcatggtgctggctcaggaaccactgagcaatctacttagacccttctcctttaaggagcaaaaggcttattctgcagaggaaggctatggtctgagggccctggtgaattaaccattgcagatgggggatggagctccccttcagccccttccccactccatctcacctaaaaaaaaaggtctttaagcgggtggtagactgagaacattggtgatacctgctacagctgggggtttggggtgggaggagctgtatccctagggcaaatacgttgtgaagcctacaccttcaagacacaggcccgctgtgtatattttagagactgagacttgaaatattagagaactgcccttcttccctcaccccacctgcaggctagcaagcccccaggaataacagtgggttacagcagggagagctgcaagagacaggctcacactgggaacagcataaaggaaagccccaaagccaagagaggggacaaaaaaggtcactagaggaatttgaagtttttgatgttcataggaacaacaaacctcaacgcagctcaactcctgactagattaatatcagttccacactaagggctcatttaccttagtatctgctaccttctatgaaatgtctggctttcaaccaaaaattacaaggcatgccaaaaggcaggtaaaagcagtctgaagagacaaaacactcagtagaaccagatgcaaatgcgatatagctgctgcaacgatcaaaacacacatgtatcttacctagctctgtccactgagtgccctttctgtgacaggtgccattttaggagccatttcagaatgagcttaacaaggtctgagcttttagagagcttacactccaacagagtacagagagcttaaccacagacaagtgaaaagataattatagatagtgaaacatgcagccatgaagaaacacaggagaggaaaaggctagagtggctagagtggctggtggagtgtgtgggctgtttcaggtgaggagaagttggagcccacacgtgaatgatgaggaagaggctcctgccattgctaagagccatccaagcagagaacaagaagcataattgcccagaggcgtgaacaaggttggatcctccctcggtctgcactgttgccttggaaggtaaaaacgctatgggcatggtgctgattacagcaagctttacaattgtgttgctgtcatggccaacctctagggataaagtggtgggtgagttttctttaaacatgtgtaagaattacctgtcttcctccattttgagggacaaggagaatctgttagatcttgtttgtaaccacttcaggacctggtacagggtgaaaaggaatgtgaatttgcaattgtgagtagatactgcatcatttatccagtgcaactgtattgttctttgtattaactcagctactccttaccctccatcccttgccccaagtagtgattattcctatgttatagatgggaaaactgaagctcagagaggttgcctgacttgaagattgcagatctattaagggtcaacccagttatttgaactctggcagcctgacttcccaggattgtgttgtgagaactaattagaaggacaggtattcttaaaagtggagcctctgatgaaaaagaaaaccgaaaaccaaacatagttgtaaaattcacgtactaagtttatgtgaaaacattggctgctgaaactgcctaaggaaatggatttagtaaatgcatgttgaactatctatcacttgttcatttgtcatgagtgcttaaaatagatgaaaatgggtaaatagttgcaacgtcccaatttctgctgtgtcttactacacagcagaatactatacagtgttattgtatagtattaataccgtgagggcaatgttgtctgacacttccctacctggaacattctggaaatcactttttgtgatctcaataactgttaagtaattggtaccagtctagtgggttgttttgtttttgagatggagtctcgctgtgtcgcccaggctggagtgcagtggcgcgaactcggctcagtgcaacctccgcttccctggttcaagcgattctcctgcctcagcctcccaagtagctgggattacaggtgcacaccaccatgcccagctaatttttgtattttagtagagacagggtttcaccatgttggccaggctggtctcgaactcctgacctcaagtgatccacctgcctcagcctcccaaagtgctgggattacgggcataaactactgtgcctggcccagtctactgttttgtagactgcatttttcacctgctcaaatgcttttcatactttttctatagtagtgtttattttttgagaagatatgagacataaaataaatgaaccatattaagtacatgactggagagggagactgttacattggattaagaagatgcttgtatccattggtttttgtttttcaccattaggggaagaaaaacaccttcccaagagtacctttcttgatacaccaaaaggttgctggtatttggtaatgatatattcattgagggaaataccaggtgaatggagagttcttcaaccattagcaataactgagcacccactgtgtgcatagttcctttatctgtaccattcatgggactgcatgttagatgaggaaaacagcaaacagcaaatttttatatagcacttcccagggaccagagacattaagtaagttgcccaagggagcacagattgtaaatggcaggtctcgacgtgggctggtgggtggcttaactccagagtctgtgttctctcacccctaattgtactatggtatagcattgtctgggtggccttggctatgttcacaaacctcaaaccagacggtaattagcatgaggggcacccaaatctgtcaggttcggagaacttctgggagtcttggctgagctctgtgatagggtactgtgaggtgtttttttttttttttttttaatatgcagccatgtcttaattgaaaccacaacttcctgtggatgccttatgatgttatttgaacaagggaaataagcacatgaatctttaaaaagtttcaagtatgttgatttttaagaatggatgcaattagtagttctcattagctccacaaattatttaccgtggaatgctttggttccacataaagccctttaacgctaaaagattttgcaggttctgctgctttgactatctagagctgatttcgactggcagctttaaacatgcgcagtaatgcaagtgccgatgctgccagcacaaatggaacaatgtattgctttaatttaaaaaacaggctttgtctcatttttgactccctttacatttaatctgactagtcatgttttctaggaggatggtgagggtgagagcaggatttgactctgttgttcatcaataaagatcctggaaaaaactggaatgtgaattttgattgtgccctcccatttgtaaaggggaaacaaacaaaaaacaaaaaccctagaagattctgaggccagacgacagtgtagccttaggctgcctaaactcagatgtgcccttcttcctaggatcttgttaaaaggcagattgtgatggcagcgggtgggggggggggggtagggtttgggctgggggcgggtaggtttggggaagctgagattctgcagttctaagaagctcccagtcgatcctccttttagtagcaataatttctgacactttagacctagctctctatcttctggctgtgtggatcacctgggggagtttaaacaacacagtttctcacagccacaccagacctattgaatcagatctctgcaggggtgaaaccagcaggtatttggggaaaaaaaaaaaagctatagaaatcatttgataatacatctgccagctttgtttattggggatgggggagtaatgacagctttgaaaacttcactgttggaatcagattgagatgtttaaagttaagctttttgacatcctaagggcttccactccaaaactacatgagctatcttagcagccacccatcttggaagggaactcactagttctttatgagtatgtccaaactggcttagatcagagagagtggaggaaaaaaagagtacttaatggttagcttgctgacctgcctagcattagataatgtctgtgaaggcccctggagtgcctccagggaagccggggcccaaatatggaaaagagaagtcatgattatgaggtaggagttgcaattaccatcgtgaatatttaaagtgttatttcagctctttcctacgctcctgggtttggggtttcatttctttttcctttttttttaatatggattctcactctgtcgcccaggctggagtgcggtggcgcgatcttagcctactgcaacctctgcctcccgagttcaactgattctcctgcctcagcctcccgagtaactgggattacaggcacccgccaccatgcctggctaattttttgtatttttagtagagatgaggtttcaccgtgttagtcaggatggtctcgatctcctgacctcgtgatccgcctgcctcggcctcccaaagtgttgggattacaggcgtgagccactgtgcccagcctggggtttcatttctagcagtgtgtggggagccaggacaggttagaaagaagggccaggggatgtctttgttgtgataaagcagataccaccatggagttttgccactttcacggtatgattttattttattttattttttttgataactgagacaccccagcaagtgtcttcttaacatttcgtaaatcttactattaatcttttcccctgaggtcaagcaggaagataagacaccaggtagagacttagctttcgccctcctcaagctattgtgtctctcttttaacttggagtctttctttaaaaccaagtgtttcccagtgttgcgtgtgtgacttttcttaactccttacattatctaaggattaaaaaaataaggggctgggtgtggtggcctatgcctgtaattccagtgctttgggaggtcaaggcaggaggatcacttgagaccaggggtttgagaccaacctggccaacatagcgagaccttgtctctacactaaatttaaaaattagccaggcatggtggtgtgtgcctggcttggcacttgggaggctggggtgtgggaggattgcctgagcccaggagttagagaccagcctggacaacatagtgagacaatgtctctaaaataaataagggaaacctcacaatcagaaaaataaaaaaagttggacattccctgtcttccttttctgaagcttctacggtgagagatgttgtgcattgtcaccatgaacttctgtgtcagggagggttggagccgagaagcagagcgctaagtgtgatctggataagggatttcctgcacgttgtggaagctgccagtgcaagctgccccctgtgtcctgtactgagtctgaagtcgctggaggaaggtgggtgtggatgagagcaaggactcctggaacctgcctctggctctcacgcccccaacctcaatgacacagtgccctgtgggagagattggtgcccttcccgaaagagaaagattagcccagtccagtgggcatctgttgagtgtctgctatgtcttgagagctgttctgggccccgggggagagcatgaggggagagactgacctggaagcacacttttccaacccgttgtggtgcgtgcccagtacgctaagggagcacaaagggagggggacctaagagcctggggcagaagaggaaggaatttgatcaggtgaagaggacgggccagagcccagagcgagtgagaatgagggtatagtgtgagtgtgaacagaggcctacagcttgatgagtacctagaaataagccttgccagagtaaaatgggaagcaaggccagaaggtgagagggatcttgcacgcccttgaaaggaacttggacttttggggtaattgggaaccactgaggcaggattctaagcaggggtatgccgcaccgtcacatgtggatggaggaaagttccttcaatctgtgacctctcctgaatgagcacctgctcccaggcaaggtttttatttatttttattttattttaatattttggagtgcagtggtgcaatcttggctcactgcaacctgcgcctcccaggttccagtgattcttgtgcctcagcctctcgagtagctgggactacagacatgcgccaccacaactggctaatttttgtgttttcttggtagagaccgggtttccttgtgttggccaggctggtctcgaactcctggcctcaagtgatccgcccacctgggtctcccaaagtgctgggattacaggcatgagccaccgcactgagcctccaggcatgttccccactggccacccctccccgagacagagccttgctctgtcgctcaggctggagtgcagtggtgtgatcttggatcactgcaacctctgcctcctgggttcaagtgatccttctgtctcagtctcccaagtagctgggattacaggcacctgccatcatgcccagctaatttttctgtattcttagtagagacagggtttctccatgttggccaggctggtttcaaactcctgacctcaagggatccgcccacctcagcctcccaaagtgttagaattacaggcgtgagacactgcacctggcccaggcaaggttttagaaacagctttgaggtctaatttacatgccatgatattgacctaatgagtatcccagtcagtgctttttaatatatttacagagttgtgtgaccatcttcacaatctaattcttgaacatttccatcacccccaaaagaaacctgtgcccatttgcagtcactctccatttccacgctcagccctaggcaaccactcacctttgtaatttctcctttttctttaaggagaatgttttctgcaaatgtattatttactttaaggagtctcccaaattataaactcttactcttggctacccggttagttactgcttagcctgttcctcccagcacacttgagattgcatggaacagaaacctgtctgggactgccttaaacacagacatttgttattttgcataattgggaggctagaggtagggtggaccccaggggcagtgtgatcagctgctcagtgtgacatcagaaacctgtgttcttgctgtctcttcccccaccgtgttgttctggcagtagcttcacccaagggctggcttccctgtggtcatcagatggttgtagaatggtgtccatctgcagtggggccctttgcttccttgctcacagcccgtatgtaggaggagttatttcttgcagtctgattgggtgagctttgttccccctgcccaccctgaagcaatgattggcttagaattaattaggctgtccttcctagagctggaaatgggctccatgggggaatggatggcacctgtgaccaggagtgggctctgctggggaaggaggaagggagccagctctactgggtaggcaaccagcagtgctcactgagggttcctgaccaactgcattggattgtttgtttcctttcacttgggggccttttttatgttaaatgcaagcaaggtgatcctctgattttgaacttgttatctgggggaaggcagaccaatcccagttcatcctggctgagtgacagcggatttgatcgttgatctcaataggcttgagagtaataatatgtgagtatttttgaagctgaccctaactttacatctctgaaaagtatcaattcagatctcactaattcaggaggttctgataatttggtcaagaagttcgctgaagtttacctttgaacagttttatagtgagggtaatattggtgatggtggtaacactaacatatgtgggaaataaatgatttgagtaacattcgaaaaacctgtttgctttaggatagaaatatctaaatatacgactagaagtaaatagtagaaaatcattcctatctagttattaacttagtcccttggaatctctccttggggaaaaaataaaatcctgctctgactatgtcagtatttgaattactgtatgaacctgaaattaacaaaaatggactttcaagtataattcatgcttcactgagccaaatagacattctgccagttatttggactttattaaattttactttattacttatatgtaataaaaaatcaaggtaagcctctgctttgcgaagtcatttatttgattaggagctgtattttagagtgcatttcagggcgaggtttgtccacatgtaagtaatgaacgtttgctggtgcagctcgtaatggtgagaacggatgttgaagaaagcaaacaccatatgccctttgtttcccgtgcatgtcctcttctggaggcctgggtggagtgtttcagctgtctcaaataatctccattttgctgttactgcagactctgcggttctccagctctctcctctctgatgttaattataacttcttcctaattaggtggctcttcctcctcctcagtcatacaggttccacactctcaagtgccagagattggattacttttcacttgatttgcgacagaaataagtgcaaagaattacaaaaaaaccaccagtgtgagtgtgtagtgggaggggcaggcgggttgggtacgggacaggatgcttagaataattttgctgccaagtgaatcagagagacttgcagttctcggagagcacggaacttattcctgcccagagttcagacacagccagaaattaccatttcatacttcacagaatggaggtttcagcagccaaagccccaagtgccgcagacttgtctgagattgtaagtaggccatacatctgttttgattgttgcgatgtctgcatcttttgtagcctgttgcccgactactttgtaggccaggagggaggcatgatggggaatttggtctcaggccagtccttccaagatggtgaccaacactgttttccacttggccccaggtctcagttttctggtttatagccgaagggtatttctttcactaagcccttgtctgtgatagaagtggattctttggctgagttccttttgtagtggcatttataaagattttgaatagctctgtcatctggtttggtggctctttccctctctgatcactatcgacagccaggtgagttttctccaggggacacggcacacagatagctgcattcaaccaaaccccctgcaggcatccatttctgcagtgaggtacccctctcaggggttgggagcaggtaacatttctgatgcagctggcagatctgggaatctaggggggaagccaggtgtggaatttagctttcctgtagtgtgaagaaataaagggggtgggggtaagaatgagatgggagacaggagagaaagtcagcttggggtctgtcaagagcactgtcctgttgccagatgccaactgaggtgtcgggagaggttcagttccccactcagctaactgtgcagccatgggctgctaaccaagatctctccaagtcttacttttctcatctgaaaatctgcatcctaccacctcgcaggactactggattgtttaaagtaatgaatgtgaaggcacctggtgcttggttgccatccttctccttttccatggcactctatgccataaatgcaagcagtgtgctgggctctgtgagatgccaccagtgttgctgtcctggcttgtttcaggccatcttttgtggccaccaagttctcatggtcagtgtcataggtttgatcttggggttggccagttggccttgcttaagtatgtagccccaggttgcccttttagtcatggccaggtgacccgcctcccaaaacaaggtcctggggaaagggtatgagtgagtcatggttatgtctcatagctaacgtttaagttaaagatgatgggaactgaggacccaagttaggaggctgtgttacaggtccttggggagagtgataattcaaaagacccctttcccgtccagctttgagtttccaacttattaaaacctatattcagccagagggagggagaaggaaaacaaaaggtaaacctcggccaggcacaatggtttatgcctgtaattccagcactttgggaggccgaggcaggaggatcgcttgagcccaggagttcgagaccagcctgggcaacatggtgagaccctgtctctaccaaaaataaaaaaaaattagccaggaatggtgacacacgcctgtagtcccagctactcaggaggctgaggctggaggattgactgagcctgggaggtcgaggctgcagtgagccatgatcacgctactgcactccagcctgggtgataggagtgagaccctgtgtcaaaaaaataaaaataaaaataaaccttgattgaaaactgccgagcagtcatctgaattctgattcagaagtacatgtaggacaccgtcatggtacttttccattgtgttgtttcatttaatgtgtttatgaatttaggcagccaccatgcacgtcggtcaagccccagttgcctttcgtgtgtgtgtgtgtgtgtgtgtgtgtgtgtgtgtttagggcactttctagagcctgctttgttaattaactgtactatgtgctttatatttgctgtgagttaattaccgatgatagtgttcccttgccagtcacaagttctctcacccctttcccccattgaattcctcatatttcatctcatccataggctcaagttgtttgtctttgactggcaagactcctcaataatcgtgtatcagtgatctctgacacagtgctaacttttatcactgattacggagagacattgtataaatcatcaggacagtttgttttgcgtatgatgatttaagagcacctcttaaccaacatcaaagtaatatatcagagtgccaaccttcggtacttttcttttgcttttcattgaaatccactttcttttctatggtctactgggcctcgtatggtctggctttgcctaccttttcagcctcatcggggtcatcttcccactcggccactgccttctgccatattgagttctcgcctgtcccagcactgtctctgcgtctggtcacttgcaattctcactgctgggaatgcccctttttttctttttggctccttgcttggctggccctttctcttctttcaggtaccactctgagcagccctccagggccatcttgtctcaagggccagcctccatcttgagtttcctttctccattcccatcacatcaccacatttatttcctttgcagtccttatatcacagcctgtaaatattttgttaactcattgatggacttggtatttgatgtctctcccaccagaattttagctccatgagggcaggggccttgtctgtcttatccctaccatatccccagctcttaactcaattctagatgcatagtaaatgctcaacagatatttgttgaatgaatagttgctttggataattaacacggtgaattacttttaagtagtttgtgactgcaagctgatagagccagtcccatgttttatgtggctggccccctccccatctgcatccatcactgctctggcactttgggagcatttcagaccccagggcactatttctctgtcttggccagcccctggctggtgtctgggataaccctctgttttaagcatcatttttgttctcaaaatgaaaaccacctgtcttcaacgtgatttgcttaaaataaatgctttatttctttactgagaccttcttccctttctgcctttctccacctcctgccaagaataatgtgaaaaaccccattatcttggaaagtggttttccctctggttggaatacaaagccagatgacttaccaccaaatgtgctgggataatagctttcccctgccctgatgctctcagatgttagtgaggtctcgaccttggcacttcctttctttgtatatttccttgaaacttccttcctacaggtaaagaagctagcccaaggcaccacctaaatggcagtgggggtagggaccatgtctaagtagcactctgtggcagactgtttgccagctcactgacaccttacaccaattccagggagttgacagtttttaccaccattttagagatagcaaaatggaggctcactgaggttaggtgacttgttcctaagcacataggttgcaaccagccaagatcagaaaccaggcttgtctgactcccaaattcatcttttatttgttgatgtactcagtgtctcccagggctatatcaaccaagttctgcagttaaaaaaacatctggcaacctggtctacggtacacatcccatgtaactgaggtaagtttcctgaaacagtagctgccttcactgtgtgtgatgccctcttgtattctccattccattcaacagatgcttgtcaggaccttctaaactgattacgtggcccaccgattggtggcagtccatttgaaaacagtttgagggacattagtgtaggtgaggtgtaaactatgcttagtttatatagaggtttacatggtgtaagctattaaaaagaatttttatggcaatataatagacatacataaaatgcgcatgagggtacggctgttgaatttttacaaactaaacacatctgcataattagcacgagatcaaaacacacaccattgatttaagcttctttgaatcaagacagaggcatgaagtacaacagaaactgatagcccctcagtttgttgtgaattacgcacaaacagcttactccataggcagactctttttggaggtccgtagcttgcctttccagtgatggggtctggctggtatttgtttgagatctaagaattgccgaaggagtggaatatggcctctgtaatggcctcagaaattagcacaaaaggagggctgactgagaatgtgcctcgtaaaatgtgaacatggaggaggaggaggaggaaagggcaaggccccgtagttgagtacagaaacattagggtgtgagaatttgtggtcatagtaattgagaccaattttactgaaatggagggcggcaaaaggaggaaggaaaaggaatttgtgattacagcaccaagcccctagaggttaaagaacgtctctgtaaaataaggaatatctacctctcatggtgagtgttgacttttagagaaaattgttctagtatactgaactaaaatgcttaattcttggcaaaagatacagatgcatctccatgcaaaagcaagctaaagcaactttgctttcataatgtatgggttctgtaaagctgtcttggtggacatgccatatgtaattcatcataatggggtgtgcatagaaatgaaagggagcgaatatcgtaacatgccttgaagcattgagtgctaagttacaaagggcattaattaatacaacttaatgggattcatttatagctcacttttagtcaaactgaaatagctttcctgaatcagggactttgggataataataaatccttttgtctttgttgatcagataagctcttattcactgacttcctgttactttcttggcacccagagtcatgcctgggcactaaggatttgctgaatgaatggaaggagtaaggacaaaaaaaatcgtagctagcatttaatgagtgtgtactgtgtgctttgcctcttttatctgatttagtcatcactacaaggctgtgaggcaggcactgttatcattttcttctttattttattttattttatttattttttgagatagagtcttgctctgtcgcccaggctggagtgcagtggcgctatctcggctcactgcaagctctgcctcccgagttcatgccattctcctgcctcagcctcccgagatgctgggactccaggcgcctgccaccaagcccagctaattctttgtatttttagtagagacggggtttcaccatgttagccaggatggtctcgatctcctgacctcgtgatccgcccgcctcagcctcccaaagtgctgggattacaggcgtgagccaccatgtccggcctatttatttatctatttattgagacgggatctcactctcacccaggctggagtgcaatggtgcaatcacagctcactgcagcctcgacctcctgggctcaagtgagcctcccacctctcagcctcctgagtagctgggactatagttgcacaccaccatgcctggctgattttttttttttttttttttttgtagagacagggtttcaccatgttgcccaggctggtcttgaactcctgggctcagtgatctgcctgcctgggcctcccaaagtgttgggattataggtgtgagccaccatgcccagcattatcccttcttttagagccaccttatttcctctacttgcctggggaccgttctggtgtatgcctgttgtcctcgcattaacattgacatcacctgctttcattctcagatgtcctggtcagatgataaaccatttcactctgaaatgttctggtttggatagacagatgaggaaactgagacacagagaagccacatcactttccatggtcaccaagctagtaagatgtaaaggtgggattctttcctgggagtctgattccaggtcatgttgtctgatcactaagttctggtgcttcacagtttaagccaagggagagataatataggaaaaccactctttatgtttttcagcttcagtatttagtaaaaatcactgccaagttagcatctgaagtaggttaatgtgactcagggcagtgggaatgtgctaggtaaagactcattgaaaccctaagtgtgtgttcattagtaaacttggccaactactaccctagaatgataatagcattcacatgtgcatggtgctttatagtttacaaaacctcttctcccatattattgtgttgaagcttcttgtgcactcagaggtgggaggtggatggccagtggtgggatttccagtttatagaggaggatggggtaatcagcaggatagtacagttgcctgcctgaggcttcacggctagaaaagaggcagatccaggattcaacccaggtattccgcctcagcgatcagtgcattcccactttagcacgggtgcctcttagccagatatatatatatatatatatatatttttttttccttgagacaatgtcttgcttgctctgtcacctaggccagagtgcagtggtgtgatcacaactcactgtagcctcaacctcccaggctcaaacaatcctcccacctcagcctcccaaatagctgggattacaggtgtgcaaccaccatgcctgactaattttaaaatttttttaagagatggggtcccactatattgctcaggctggtctggaattcctgggctaaagtaatcctcccacctcggcctcccaaagtgctgagattacaggtgtgagccacccatgcctggcccagatgctcttatatagccatttgagggtgctgtttatgaagggttagggagtcacttgaagactcatttacccagagtttcttagccttggcactgttgatattttgagccagttaagcctgttgtgggggctgtcctgtgtgttgtaggatgtttaggagcatctctggggtctactcgctagatgccaatagcacaatcgcccgtcccgcccctgcccccaccccccgcccccgccagatccctccaagtcgtgacaacaaaggaaagcgtctccagacattaccaaatgtcccttgctggggcacaattgcctctggttaggaaccactggcctaacataatagccacatttaaaagagggaaagacgaccttgaaaatgttagacctgtcttcttcccctttctctagtttctaaagcatcagaaaaactgttgaaagacctgcaaaggggcaaaatagagaacaagcaacatgtttcatgttgaattctcttccgtggaagagcattgtgtctgccaaaggataagatagccaacatttttttaagttaaaaatcacacagttaaaaatgttttgatagaaaagttagaatagagatcagccaaaatatacatatgcagaatctcctgtaatcctactgccgagataaccatggttcatattttggtctatttccttctaaccttttccagcatgcgtatacaagtatatattaaaaaaataattttccaaatagagccataccaaaagctgttataaacagctttttaatttaaatgtgccacaaatacctttccatatctatgatacagagttactaaggtttgtagtattttgttgtatggctagcatatagtttattcacttagtctcctgttgtgtacgtttggtttgcttctaattttgtttttgctgttaacatgcaaaaccgtggtgagtatccatgtgcatacttacaccctttccagcttattttttttccttctagaagttaccatcactgtaatttttagtatccattgagtaagatattgaattcatagtgttctggattgtattttaattatgtcacatacctttacccctcaaaattacggaaatgtattgattaaaaatgtgtttatgtgctagacttgcagaatggggtgtggaaagttctttggttttctgattgaacgatgactaataagaaaccatttgggtttcgtgccttgttcatgaagcccagtcttaactgtgtcaggctacttcctgagtaggaatcagcccagtgaaggttgcttaaccgtcctttaagattctgttcactactgaaagaaattcaaggctatatgctcgtgaattctcattgctcatggatttttcttctatgtgttttaaattataaactcacggaaaagacattcagatggtagagaagagcataaagtttcctactttactcccctccctcttggtttttttttttttttcattctctaggatttttgtatgcttgtacaaatattgaaatacaaaaaaatttaaaacccacaaattgggcaacagaatgcaatgtgtgagccaagtagcttttttctacttaatgcatctttctatatcagcaccttattctgtttaattggtgccctatttggggttgttttcagcttctcctgcaacaagtcaccttctattatgagtctatccataggatacatgcttagcagtggagttgttgggttaagagtttatgtccttatggttttgatagatattgctaaattgcccttctaccagcaatatatagcttgacttgtttctatcaggcatttttttcatgcctggcataaattattgattaataagctgggaacacaaaggtagaatctcatctataggaaggagcatagttggttaggagaccatgtcttccctaatgaccattatgagtattggttttcagccttgagcatactcagggggatgtgtatttactggtttcctcctggggttggcctgaaactggcttttacttttttcaaccacagagttagaatatgcatataaagttgggagacaatacccagatagacaactttctgggagtattcgatgacatgcctcaattagaattgaggtggttagaaatggacccttattactaaagaggttgtgacatgtaaatatcagtgggtctctgaaatagaagcataggtcatttggcatttggtacactgtatcaaatggaacataatataataaatgtaaatgtaacatgttataatcatgttacagtcattactacccctcttatctcttccatgacgtcttttctgatgtttcttcattccccatcttctcccactccaagatgactttttttcacactgtccttaaaaaaaatatagctggtactgcatttagggctttaaattgttttattatcttggatcagatatgtatccctaatcaaattttaaccaacacttggtttctggtcctcttcactctggctgggtgtttggaacgtaagtattttgattggttgtccactctagaattcttctgatttcatggggtccctgtgcttggtaaaggagggctctctcctggacatctcccccttgtaggcccccagaacggtgctcataaaggactctgtcatctcagtcttcagagcactgctttcctgcctagggaagggcacagcagggtgccatcttttatatgatttggtatctgaaggagcagaggatggtagatgtttgaagatgattctgtgaaccctggtgggtacggcagctgccagagcccaggtaaccatgtgaagggctcatattttctgaaaagtcagggctttctgatgggcactttttagggtattcttggccaggatttttttttttttttttgagtcggcctgaagtgtcctggaaggtggaagctaaaatccatgtaggtttggcctcaggctgggcctcttagaggaggtggggcagctttcatttcctttctccttgagccccgagggctgacactgtgccctggggactctccctggcctttcccaggggatgacctcgagagagtcttaaaaagggaacaaaccaaaaagctgttatttatttttcttattgttcagataatatattttcctttatagcaaatgaagagggcttttagggggcaggcagtgtgatctgaggaaaatggcctctggggtcaaatagttctgggttggaatgtgggctctgtggctttttccctaaggggctattatgggccaaattttgtccctaacccccctgtacctcataatgtgactgtctttggagataggtcctttaaagaggtgattaagttaaaatgaggccattagggtaggccttaatccaatctgactggtgtcctcataagaagaggagattagggctcaccgagagataccagggacgcagacgcacagaggaaagaccatgtgaggacacagcaagcaggtggctatctgcaagccaaggagaggggccccaggagaaacccaatgtaccttgattccagccttcagagctgtgaggtaatgaatttctattatttaagcccccctagtctgtggtattttgttatggcaacctaggctgactaagatgggggcttttagcaagtcaggtcccctgattttgctttcctaaagagggaccacaacaccctgagttgacaagaagagtggacacagtgcctggcttctaggaggtactttcaaatggcagtggtggtggtcaccataatcatttaataatatgataatagaaatcaccacccccttccctcacccaagttttctgaccccgtctggtttgaggtttttctttttctttctttatttttatttttatatatttttttgagatggagccttgctgtatcacccaggctagagtgcagtggcgcaatctcagctcaccacaacctctgcctctcaggttcaagcaattctcctgcctcagcctcctgagtagctgggactacaggcatgcgccaccatgcccggctaatttttgtactttcagtagagacctgattttgccatgttggccaggatggcctcaaactcctgacctcgtgatccgcccgcctaggcctcccaaagtgctgggattacaggcgtgagccaccgtgcctggcctctttttatttttttatttttttaactttccttttaagtccttttcaaagagggttgcaaagaactcatgtgatcagagattggtactttataggttgagtgaagtattttcttttgagtaacccttttcatccttttcatctgttaacatattggaggtccaggtaaaattgtatttaggacaaggattctgctgccaaaatagattcaaagtgactttcagcgtggtgtgaatatttactgtacctgacacccattgtattagtttgcttgtgctgctgtgacaaagtaccacatgctgtgagtggcttaaccagtggaaatttattgtctggcagttctggaggctggaattcagagatcaaggtgtgggcagggttggttccttctgagggtcgtgagggagagtctgctcctccccttgcttctggtggtttgctggcgatctttgggttgtagacacatcaccccagtctctgtcttcatcttcacatggcattctccctgtgtgcatatctctgtgtccaaagttcttcatttttgtgttttttttttttgttttttttttttttttggagatagaatcttgctctgttgctcaggctggagtgcactggcacgattatggctcactgcagcctccatcttctgggctcaagtgatcctcccaccttggcctcccaaagcgctgagattacaggcgtgagccacagctcccatcccaaagttctcctttttataaggataccactcatattggattagcgccactcaaatgacctaattttaacttgatcatctgcaaagaccctatgtctaaataacgtcatattcatggatactggggataaggacttccatatcttttggggagatacaattcaactcataacaccaattatattggaaccctatttgccatctgtgcacctctgcctgcgtccggcagcttctcaggagaagtccctctgcctggtctgccattcttgtttgccatgcagatttcagcgaagaagtcacctgctggagaggccttccctggccaccctcaatatagagtgattgaatgagtgaaatagattgcagagtaaaattaaaatgtgattgagaattatgctgagcataatttacccttaaaagtgtgagagaactcctctccaccccacatcaatgttacttgtaacttttttgtatatgttggctgtgtccccatcacagatgctatttaaatatcattttgtgcctgtgaattgagatgtcgggcaccttctgaatgtcatgatgtttcctattctgtgtgcagagcatgccaagaggattcaatttgttgaatttggatctttttttgcaatgagtcactatttgattatgattttacaacaattcacagaatcaaactggctagaccccttctctgaaggacatcttgggtccagaaaacctgtgaatcatgaataagggaaacatttactaatgctagttaattatcagtgtttgttaaatatgttctccttgctgaaactgctaggggctgtgcagaataccgaaatagaataggcaatagctgtggcctccaggaacacacaattcacatcaaacagccaaaaaatagataatacatgcaaagtggtgtgagaaggtgtagtacagaaattaagaagaagtgcttgttgtggaccagaaagatcaaggcaggctttgctgaggaacttagttaggcttgggctgtgccttaaagagttagagatcccaggagaggagggagaataccagctcaagacaatattaacataatatcattaagctgtataatagtcacagtatatattgaactaccaggttttaataaaaattttcttcacaagatagatatgaaatgatttgtaacagaaaaatattgtatacatcctaaatgtccatcaacttgggatatataagttatagtacatccatatagtagaatactctacagtcagaaaaaagaatgaggatgctttttaccgctgtggaccttccaaatatattattgttcagtgagaaaagcaaggtgcaggacagtgggtatgatatgctaatgtatgatattttcttaaagaaactagaagttgcctaagaaactaataacctatgtgtggtagtggtagactgggagaatgggagctagattctgtgtggggatgtttgtgtgtatgtgtgtgatttgaatgatgtaaatgtatcctattcaaaaagttaggtgtgaagacaatagtatttggtcacactgttgctacccttaaattgacttagtgctttgccttgctgggacataataaacgaagataattagtgacaccagatatcttagagataaacttttgcatttgcccagagaatgaaattcccttgaccagctttcacttttgttggccgccacaagaaaggtttgaagcatagcactcaatagaggggctggtctaatgaacccctttttacccatcgtctagcttcagcgttatcatctgctggccaatgctgctttgtttgttctctctcctcctcattcttcccttcttccctggccttgattattttgaaggcaatgccattctgatggaataatttagaattattactctgacctcctgagtcccaccatggccccagacatgcagagtacattagatgcttaggtgggaaaagctgtctttaatggaatttggctcatcacattaaactcatttgattttacttaaaaaaatgtaaaaaattattgtgcaatacaggtaacataaaatgtaccatcttagtcatttgaagtgtatggttcaaatagcactaagtacatgcacattgttgtgccactaatcttcagaacttttttatcttgcaaaactgaaactctgcacccatgacacaccagctccccatttccccttccccccagcccctggcaaccaccattctgtgttctgtgtctgaatttgactcctccaagtagttcatgtaagtggaatcatatatgatttgtctttttgtgactggcttattctacttagcataatgtcctcaaggttcatccgtgtggtagcatgtgacaggatttccttcctttgtaaggctgaatcatatcctcttgtatggatataccacattttgtttttccattcagtcattgatagatacttgggctaactttactttttgccccctcttagaatataaggttttatggctcataataatttcatgctgtagcacatcagaatgcctcagcacactattaccctccagttaagagaataattctgagcagtttgagaatatatgtatttttgagacagggtctcactctgtagcccaggttggagtgcagtggcgcaatcttggctcactgcaatctccgcctctctggctcaagtgatgctcccacctcagcctcccaagtagctgggaccacaggtacgtaccaccacgcctagctaatttttttttttttttgtattttttgtagagaccgggtttcaccatgttgcctaggttggtctccaactcctgggctcaagcagtccgctcacctcatcctccaaaagtgcttgagaattcttataccaaatactttgacttgaaaaaccagcaaattttcctttctgcttttgtgaccaagggcagcattttctctcaaagctcttacattgaattttgtctctcaccagactagattatgaatttagagagactagggcagggggtggggtgatatcttcatttgcccagtacctggcactgtgcttggcactgggtggatactgtgtatgtatttgttggaggaggagtgttactttgggcaaggcatgtacctatacctttataattaggaagttgaaccagatgaattctaagaccccttttggttctaacattgtttgggtccatcattaaacctgaaaatcccaggctgggcgcggtggctcacacctgtaatcccagcactttgggaggccgaggtgagcagatcgcttgaggtcaggagtttgagaccagcctggcccacgtggtgaaaccccatccatctctactaaaaatataaaaattagtcaggtgtggtatgcctgtaatcccagctacttgggaggctgaggcaggagaatcacttgaacccaggaggtagaggttgcagtgagctgagatcgcgccactgcactgcagcctgggcgacagagtgagactctgtctaaaaaagtaaaataaaataaaataaaaaataaatctgatgatgaaaatttcagactctctggaatactggagatttgggggaggtagtgaaatttttggatagacatattttcactgcccctcaaatgatacccagaggtggtcacctacaagtaaacccatgtcaggatatagtgtttcttaaaataacattctggatttgggacttcctctttgtgcagtgggtgccattctttgaataataaaaaagctaccatctaaaaagtgattttaagtttagcttaatcgtgtaccacatttcctagatatacacggatagaaaacaaacctcctcttgacataatcatctttataatgaatctcatcggaagtcttaatggtaatcttaccatgagaagaagtcaaagcaatgagcaactgaggaaaatgaaaattctggaattagagaaaaaaatgctgataagaaaggacagatgtgatctgagtactgaatcttgttgattttctgaactttatgctcatttgtacatttttattttaagcctggtttccaaaagtctcttgttagcaaccagatggtcgtcaaataattgatacgggttcattttaagcccatttgaggaacataatggcctgaattttccagtagcagggtttagtaattctgctggtctttgaatgccaacagggttttttggaaattgagttccctaatgtcttggaagtaactcttggaaaataggaaccagtgaattgattgcatgatgtacttggaataaaaagttaaggatatggtttattttggctaaaacgtccacccttagaagtggttaaatttgtaaaattaggtgaggatttttgtgtgtgtgtttaagtttttttttatttgttttctgaggcttgagttaatgaatatgaatagacatttcgaatacactaatctgatatttcccattttcagagatccgttcaaactctagggtctgtgcacgtttttacttacatctgggagctaaaaagtctgagctcagaaacagagtagaattatggttataagaggttgggaagggtacagagagaggagggtagggagaggttgattaagggatacagaattacagctagatgggaggaataagttctagtattctgtggcatcataggctgactataaacaacagtttattgtatattttcaaacagctagaagagaggatttcaaatgtttcaagcacgaacaaatgctcagtgtttgaggtgatggatatgctaattctgatttgatcattatacattgtatatatgtattgaaatagcacatgtaccccataaatatgtacaattattatgtgtcaattaaacaaaacactggggtttgctattctaaagtcttactaaatgcttttcaaagaaagaaaaactccttaaagtgtggtttgcaacgagaaaaagggttgtgagctgcctccagagtcagtgagactcaatggtcattttgttattgtttttgagacagggtctcgctctgtcacctaggctggagagtgcagtggcatgatcacaggtcactgcaacctcgacctcttgggctcaagtgattctcccaccccaaccacctgagtagctgcacagtgcctgtgcacgcgccaccacgctggctgatttttgttgttgttttttttctcttggtagacagggtttcgccatgttgcccaggctggtcttgcactctgggctcaagagatcctcccaccttgtcctctcgaagtgctgggattacaggcatgagccaccgcacctgacctgttatttgaactggagaaaggcatcagcaactgttttgggggtgctagtgagccgcaggttgtattgctggaaacagtgaaagagagagctgaggtctgtctgaaaagcctcatgaactgtcagagcggtgacagagcagctgtgctatggagaggtactcctttcaagtgctcttttagttggtattctcagaatgtcactaggtgtttccagcagaatcccatcttgcgaaacgtgtctgtcctgggctctctgttttggtgtgtgcgtacaaagccttcctttcctctcctctgctcacgccaccatggctagccagtctctggctgtcttgggatctgagtggagctcctggtggaaccagacccagaggcctcattggtggacaggttagttttccttggctaccacaacaaatgaccacaaactgggtggcttaaaacaacagaaatttattctctctgatttctggaagccagaagtccagaatcaatgtgccctccaacggtgttctaggggagaagccatttcttgcctctcccagcttctggtggctcctggctttcctttgcttccagccgcatcactcctctctctgccttcctcttcacattgccttctcctctgtccatcttctcctctgtgtgtctcatatgaggacaacacttgtcattggatttagggacccccaggataatccagaatgatctcttcatctcaggatccttaactacatcagcaaggaccctttccccaaataagatcctgattctgggaattagaatgttgacatatctttttagggggttgccattcaatttaccacagtaggagtagcaattcaggatggggccttgaaaaggaagcagaagaaacagaagccttcataatgtgatagtttaaaaaatctgcctggtcatttaaaaaaatccttcagaaagtaactttattgaggcacattttaaatatcatgtaattcacccatttcaagaatatagctcaatggtttttagtaaacatacccagttatgcaaccatcatcataaaatgctttagaacattttcatcaccccaataacatccacatccttcatgcccatttattgttaattcccattcccactcccagcttcactgcctgctgtctgctgtctctctagatctgccttttctggatgtttcatatgagttgtttttttttttttgtgaccgagtcccactctgtcacccagactagagtacagtggtacaatcatggctcactgcagtctcgacctcctgggctcaagtgatcctcccacctcagccttctgagcagctgggaccacaggtgcatgccactatgcttggctaatttgttgttgttgttgtttagacgggtttcactatgttgcctaggctggtctagaactcttgtacttaagcgatcctcccaccttggcctcccaaagtgctgagattgcagacatgagccaccatgcttggcctaaagttttatttaaaacttaagaaaacatttctgattgtaaaatatggagaaggacaatcccatcacctggagcctgttagaaatgcagaatctgcagtttagcaagatccccaaggcattctctatattagacttagacatactggtacattgtatctgctatattgatcccttgtccacttaatatattatgagcacttccccaaaagtattatatctcttctgagaacattttaaatctcattgtaagaatataccacaatctatttaactagccacttcatggcagacattgtttcccatctttttttgcccttgaaaataaagctgcaataattatctttgtatagaaatatttgtgtatagttttatatctactgtatcagtaattccatttctaggaattgattataagacaataattatagacagactgctaaaatttagaaagtgcatatgtaaatactgatcagtggagtcagtcatttaaagtgctgttttccagcatggtactggtaccaaaacagagatatagatcaatggaacagaacagagccctcagaaataacgccgcatgtctacaactatctgatctttgacaaacctgagaaaaacaagcaatggggaaaggattccctatttaataaatggtgctgggaaaactggctagccatatgtggaaagctgaaaccggatcccttccttacaccttatacaaaaatcaattcaagatggattaaagacttaaaacgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcattactggccatcagagaaatgcaaatcaaaaccacaatgagataccatctcacaccagttagaatggcaatcattaaaaagtcaggaaacaacaggtgctggagaagatgtggagaaataggaacacttttacactgttggtgggactgtaaactagttcaactattgtggaagtcagtgtggcgattcctcagggatctagaactggaaataccatcccattactgggtatatacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtcaactattgtaagaacaaaaaaccaaacactgcatattctcactcataggtgggaattgaacaatgagatcacatggacacaggaaggggaatatcacactctggggcctgttgtggggtggggggaggggggagggatagcattgggagatatacctaatgctagatgacgagttagtgggtgcagcgcaccagcatggcacatgtatacatatgtaactagcctgcacaatgtgcacatgtaccctaaaacttaaagtataataaaaaaaaaataaagtgctgttttcctggaaactagacctaaagccaagcagataataggaaatgtgaacccccaatacatgatgttagcacatcttgctaactctcacctccttctcctcctccttttttttttttttttgagacagggtcttgctgtctcacccaggctggagtgcagaggtataatcatggctcactgcagccttgacctcctggggtcaagcaatcctcccacctcagcttcccaagtagctgggactacaggtgcacactatcacacctggctaccttaatttcttttctttatagagacagggttttgtcatattgtccagtctggtctcaaactcctgggctcaagtgatctgcccacctcgccctcccaaaaggttgggattacaggtgtgagccactgcacccagccacctccatctgcttgagcattggtttcattgttgaacaaaatgaatgagcaaataatgaatgaatgagtgaatgacaatggcatcaaaaagtgaagtgtaggttgttactgagcagcggtgaaatagaaaggaacaaaatgctggacccacatgtaatcactttcttatctgttgtaattttatccttactcaatttccaacctccactagtcggttctgcccttgtaaagcagcccaatgtgtcactcctggaagcccctgctgcttcaactatctgtagcacactactcctcataggtggaaagtcagtcatgggagtgacgataccttcctcagatcacacctactggcctttcgattccgttttcccacttttcacaaggattgtagtctcttgaatatttactggccttcctagttctcagatccttgggaagtatgtgaagaggtcgggacttgtgtattcacttcgtatctgcccgattgccaggctccttaggtcaaggaggaattgagtgagttccaaggagagggtaagtctgaattttcccctttttttcttttctttttttttttttttttgagatggagtcttgctctgtctcccaggctagagtgcagttgcacaatttcggctcactgtaacctcagcctcctgggttcaagcaattctcctgcctcagcctcccaagtagctgggattacaggcgcccgccatcgtgtccagctaatttttgtatttttagtagagacagggtttcaccatcttggccaggctggtctcgaactcctgacctcgtgatccacccgccttggcctcccaaagtgctgggattacaggtgtgagccaccgcacccggccgaattttcccctttcattttctgcactgctgtgttctctgagctttccactgctatagtgtttcctgatgagaaggaagtgtttcctccagcttttttttcttcctggaggagtaggatatgaaggaatccctgcccccacacggggtgggatccagccagctgctccagaggatctcggcccctcctgtagcctcaaccttttttgtttctctgggtggtgactctcacaccagagcatacgttagaacctcctggagggcttgctcaaacaccgactgctggaccccaccccatgccttctagttcaatagtctgggctggggccagagagtctgcatttctaacaggttctctggtgatgctgctggtgtggaactccactttgagaactactgctctggcccacccctcattgcccctcttcccctgcaattgcttccaagtaggcagaataaggcgctggaggactggtgtgtttgagacccttgcatctagggagcccgtccagacttctaggggtagcgcctagcagtggtgtgtgcctgttccaccaatgaatgcagctttagacaggcccttcagagtataagaagcagtggctcattcaaattccttcaagtagtgggggtgagaactagggggttaaaaacagagccccaggtccttaaggcttcacaggaactcatccagaaagccagcaggtatgggcaggctggggcctcagcctgccacatgcctttgtgtttcagctggcccaaggctgtactgaacattataacctttcagccctggccctttctgttgacttcctctcctctcctcttggtgggattttcccctgtatttagggcagggcagtttcttctggaaggatccctttggctccaggctctgtgtctaaccctcccacttgaccctgtagcacacagccctggccagttgctggtggaagctgcagtccttagtgaaatggggagtggactgtggttcctcaaattgcattgtcatttggaggctcaagggcataccttttttatcctcaaaggcttaaagacaactgatggcagctggagagggttaagggagatggaggaaatcttcattcaagtttgtcttgctcagtgatcttttaatgtgtctttccagtcttggggtggttgtgtggtctttcagtacagattcaggtggcaggcggttggtggtttggtttaaatcagaggtatgttaaaatattcaggatggtgagggtgtctgtgaaaactaagagaggaagtggcttaaagagctaggctgtcagctgggtgcagtggctcacacctgtcatcctggtgctttgggaggctgaggcaggaggatcacttgaggccaggagtttgagaccatcctgggaaacgtagcaagaccttgtctctacaaaaaattaaaaagaaaaaattagctggacatggtggtgtgcgcttgtggtcccagttactcagtaggctgaggtgggaggatcacttgagcccaggagtttgagattacaatgagttatgatcatgccactgaattccagctttggtgacagagtgagaccctgtctctctctaaaaaaaaaaaaaaaaaaaaaaaaaaaaccaggttgtcaagctagatttagaattctttttttaaaaaaaattcttttattttttccatgggattctgcttgatatagacttaattctgttgtctgttggcccagggacatcactgcccagtggatacctcatccactcccactctttttgagggttttctccagggagttgaatctgtgaggcagtctttccctcctgctttcatttctcccccagcatcttctcttaggccctgctaggccacttgagcaagaatctcaggccataaaacatttccacatcagatttcctccaacagcacagggcgcttatggctcacatgtggaagcgtggacattgacatgttattttgagacttctgactttagagcattttgaggaaagtatcttctgaggtctttctttcctgtaagctagctgtagtagccaattccttttgggggatgggggaatgaattcttggcacactctgttgtcctttgggctagtcacatttgtgctaaatatcaggcgagctccctgcggacaccatgggatgaggacaacatcttattcttggcaatttgcaagggacaaattaggctgtggtacttgcaagtagaattattaaatatcaatgggggataataaatgtgaagtagcttgcaaatcttctgatattatggctgtttcagtgaaaacacagctgctaagatactttcctagctgtaatcgagaaggtaattttcctgaaaggccatttaaagcagatctttagtgcctttggctcattaagaagcatgaataggggtaagtctctgaaaaagatgaattagacacagagcagaggagcggtggtgtccatgatgcaggatgatggtgtccagggcctgcgtactccaaatagaccaaggactaattagttgtgtggtttattaatggactggagtcaatcctggactaatacaactaattcttccatttagagttaatgttggcactcaattttccctggtaatgagtgagttagagtaagcaggcacgtgagtgtaagatacagtgctaatattttgtgagaaacattgaacgaggcttgatgtttaaatcaatagttgaaaatgtgggggaagactttccagaaaaggcttacaggctaaataagagcagttaattgaaagcaaaccaagcccacccaatatttagatttgtttagaaaccaagtgaacatttgagatgagaaacatttctctagttctgtgatgtcgtcggctttcctggtgtgtttggagcttttgacattggtgtggtactttacctcagtgaggctgatggaacagagtggatgttacagggcctcaatttcagaattcttgttgtgtactcgtgaagacctgtggagagattttgcctcaagtcagtttggatggtttctgccctccagtctgataaagtcccctgatgtcaaaccacaggtggaatttccagagactgtgatctgtggactggtgacaaatcctttgtgaaaagtctgtgtgacactactaaacagagagggcttgggggaggagaatgaggggaccaatgcgctcccctcagaagccttgatgctctcatagaaggtctggccaggtgtgggggtctagctttgtaaagtaggaagacccctttgatgattactttttttgtctagttaaacctttttggatttctctgtaatttaaagaatataatttttaaaatgtaaagctgaggattcatttttctatgtgttaataaagttaataaaccccccatatttattggggaaggcagtataaactagaatttccttaggtttcttctttctttctttctttctttctttctttctttctttctttctttctttctttctttttttttgagacaggggagtgcagtggcgtgaactcggctcactgtaagctccgcctcctgggttcacgccattctcctgcctcagcctcctgagtagctgggactcctggcgcctgccaccacgcctggctaattttttgtatttttagtagagacggggtttcaccgtgttagccaggatggtctcgatctcctgacctcgtgatccgcccgcctcagcctcccaaagtgctgggattaaaggtgtgagccaccgcgcccggcggcttaggtttcttaaaagttaaccaagtgagcatcactgaagattaaccaaaggatctatgcaaagatgtatttttattttgctcaaacagttgtttataaaaggtaagatgaaaaccaaagcacacattacagagtaggaaatcaagtacttttatttcataccagaaataggaggaaaaggataaaatcagggtgaagccctaaaaaaaagacagtcaaaaaagaccctataggagggctgggagagtttttgagccatgaggaccatttgaccttggtgacagggcagctactgagttcccagaattctgccttttcaagccatgtaacatttgcaaatgctgacaaacagctgctaattccgttttctatgaaagggtgacagggtgttctcaggacatgagcttcttctccccagagccacatgcctttcacacagtgacagtggcaccatcagtgaggacctgggaaggagacaccagtccagaaaaatgatgattcttttttttttttttttttttttttttttttcgagccggagtctcgctctgtcgcccaggctggggtgcagtggtgagatcttggctcactgcaagctccgcctcccgggttcacgccattctcctgcctcagcctcccaagtagctgggactacaggcgcccaccatcacgcctggctaattttttgtatttttagtagagatggggtttcactgtgttagccaggatgatctcagtctcctgaccttgtgatccgcctgtctcagcctcccaaagtgttgggatgacaggcgtgagccgctgcgcctggctgaaaatgatgattcttataggggggtgtgtgtgtgtctgtgtgtgcatgcacgtgtgtgtgtgtgtgtgtgtgtgtgtgtttgtgtgtgtgagagagagagagagacagagactgaattgcttgagaaaatttgcatttgagttcagaagtatgagcccacatctgtgaaagcagtaggtaagagactagtgaatgcagatgactcagatatgcacacaaacctgtggatttacggttttagaaaatacaaatatacattgtgctaaatttgaataatttgaagtgaggtacaattccaaagagcaagttgtgatctaggacaaaggaacctctgggatgagtgacagctcggagagccagaggtggaaggaggaatgaaacacagctactaaggctacctgtgtcatgggccaccctggaggctgggagatctcttcttatgggtttctctcctatttgtgtctgtgtgcctatctgtattctctatgtgagtctctatgcttgtgcatcagtgtctctgtgtatgggggttctgtttttctgtgtctatgggtctgcctctcccactcgctgtaaacgggctaccccagaaacacttgccagatggagcacactggcctgggtcaatgccacatatggtttcttacaagttgcagaaaggttacacttagcaaaaatgggtgtgccccaaagccccacacagtgaacaggttttctcatgatcttgtcacacctgtcacaagagtgggggaagatgaggaggaagagccagctggaagttttagaatcgtgtttaatttgtggtttacatcctcctcccgacccttttccctgacaaaccacccacacacttttcactttgcattacatttgtcctcgcccatctccatgggatattcctagaattctgaatgcttcctttgactttctctactgcagaaactcttctccctgggaatgatttttacagctccagttaattttcatgttcaatgttggaacggagaggaaatggggggagcatgggtggtgactcaggaagctgaggaaatcgcccttattaggcctcgaattttcttctaaaaaaaaacaaaaaacaaaaactggccccaggctgtttgggccttatttttttctgattgctagctttcatttgacctccctccttccatttctttctctctttggttctgctttgaaggtcacaaagcttcccaaagctgttaaaggtggtgctaactccctttactgaaagattactcttcagctgtaccagtggatttcccctaacagcgctcccagaagatgaacagactctcttattgttggtaataactgagtttttaaagaggacaccatcattggcaataatttaaatgacttttctaaggtattttcccaactgtttttctctttttcctcttccacttgagcaaatgtcatgaatttccttttttttaaaccaccaacacaagtattttttttcttaaataatgtgtatacttaaaatttgtaaaatgcaggcaggaaccagaaagataattcattttctagccagtcgtttgttgtaagcctgatatgtgtttgttatttttctacaaaaatggaatcatatggtaggtggtgttttataagaagtttttttttttgttttaattgtggtgaaatacacaacagaaaattgtaaccaattttttttttttttttttgagacggagtttcgcttttgtcgcccaggcaggagtgccatggcagaatctcagctcactgcaacctttgcctcctgggttcaagcaattctcctgcctcagcctcctgagtagctgggattactggtgcgcaccaccatgcctggctaatttctgtagttttagtagagatgggatttcaccatgttggccaggctgatcttgaactcctggcctcaggcgatctgcccgctttggccccccaaagtgctggaattacaggcatgagccaccgtgcccagctgtaaccaatttttaagtgtaatactaagttacttaattttctacaacatcagtaatgtttttcaagttttttaaagttgcagaaccctttcctcaaagaccagagagcttcaagcagagctgcaccaccattgaggcaggagtggggagcccaggctatatcttgtcaatgttgcagtttacggttaccctccccatagctttgaggcctcctagggatcctggtcacactcagtagccaactttgaaagcacatagacctaccttatactgccccaattgttaatagcttagattgctctaattttcttataaagaaaaaattttggacatactttaaatcctctttgaagcacatctgtgattacttccctagataagtccttataagtagagttactgggtttagaatatgagcggtgttgttgtttttttctttttggcctataatccatattgccaactggtcttcaccaaagtgtgccacatcagactctcacagtaatgtaggagaaggctcaaccccccattccctgggtaaaataaaccttaaaaattcagtatgttagcaaaagaaattatcaacagggtaaacagacaacctacagaatgagagaaaatatttgcaaactattcacctgacaaaggtctaatattcagcacgtgtaaggaacttaaatttacaagaaaagccattaaaaagtgggcaaaggacatgaacagacactttttaaaagaagacctgcatgtgaccaacaagaatatgaaaaaaagctcaatatcgttgatcattagggaaatgcatatcaaaaccacagtgaggtaccatctcacaccagtcagaatggctattattaaaaagtaaaaaaaaaaaaaataacatgctggtaaggttacagagaaaagggaacacttatacactcttggtgggaatgtaaattagttcaaccactgtggaaagcagtgtggcaattcctcaaagagctaaaaacagaactaccattcgacccagcagtcccattactgggtatatacccgaaggaatataagtcattctaccataaagacacacgcacaagtatgttcattgccacactcttcacaatagcaaaaacatgaaatcagcctaaatgcccattagtgatagattggataaagaaaatatggtatatatacaccatggaatactatgcagccataaaaaagaatgagatcatgtcttttgtgggaacacggatggagctggaggccattatccttagcagactaacacaggaacagaaaaccaaataccgcatgttctcacttataagtgggagctaaaggatgagaacacatggacacaagggaacagacatgggggcctacttaagggtagagggtggaaggagggagaagagcagaaaaaataactattgagtactaggcttggtacctggatgacgaaataatctgtacaacaaaccctcatgacactagtttacctatataacaaacctgcacttagtgacattattttcgtatgtctgttggccatatatggttcttctttgaactatttattcataacctttgcccatttttagattcagatgtttgtccatgaatccgagagtgagaacccttggttatactgtgtgtagacattttaagcgatattttcaagaatcagctgtgacacaaaaggagtgggggattgtgggccaaaagtcttacagtcagagtttagcatgagaacttggaaagaataaacttctggactttgatctctgattttatgattctgtgatactagatgacttatctgccatttaggaaggttctgtcatattgactagagagaaaatccggagttaaaaccaatggctgcattaagttagattttttttagcagtctgattaatctttactgctccagtactcaaactgcaacgtgagagttcaatcttgtggcttattacaaccacacattgtattaaacatcttctacttgagaaaaacatgaagtgccccatgtgcattttgagtatgttatatcatgagtaaagtcatggctggaaggtagttaagacagaatttctttttgtttgtttggcaagtgatgctaaatcaacaataatattgctttgaaaaggagcaaaattatgccatgactatttgcaatgaaaataaattataaggcctggtgtggtggctcacacctgtaatcccagcactttgggaggccaaactgggtggattgcttgagtccaggagttcaagaccagcctgggcaacttggcgagaccctgtctctacgaaaaaaaaagaaaaagaagaaaaagacaaaaattagccgggcatggtggtgcatgcctgtagtcccagctactcagaaggctgagatgggaggactgcttgagcctgggaggtggaggttgcagtgagctgagatcgagccactgctctgtactctagcctgagtgacagagctagaccctgtctcaaaaaaaaaaaaaaaaaaaaaattataacgcagctgtataataatattgctcaatatgctattataaagtgaaaacctccttctgcttaacaggaggtgtctctatttcaggacaggacactttacatggaataagaacaaagatcttactaatttaaaaaaaaaaacccaaatgtgtgtgtgtgtgtacactgaatttggccagacaggaaaacaagattaaaatgtcagttctgtcttttcaacctgaatgcctccaacagctacattttagaaatttctgaaataattaatgtgtactcatatgttcacccataaatcagaccatgggattactgatgaaaggatgcaaacttgggggtcagtcttggaaaattttgactgaattttaatcttcctattgtgaacatctatttcatgttgaaaactcagcatttcctgtttctcctaaacatagacaccacaataaatagtttgtatctatttcttttccttcaaaaagatcacagttctttgcctgtattatctagctccaagataaattaaatgccagctgaaattgtttggtgtatctaggatgcccatggtatgtgccatttggttgtgtggctgagtcagtggcgttaggtggagtttagcctccccctgagtggttattagggttgtggatggaatgtattgaattcaaatctctcatttataaggcgaggtgtgaattgtagaatgatccgattaacttgggctgaaccccagatattgctgtgtgctttttttcccccttcaacatgtcatggaggcttaaaacagtcacccacacgccctttccatatttaaccttttggaggtgctgtcttattgctgagccagggtggtaatagctgactggcttaaatggacagacagcaacaagatagctgaggagggtaatagatcctgccattctgttcatctgcgtttgtgtctgggtaaaattctcattaagttgcagccagtgtgtgtattttgtgtgtctgtgcattgtgtttgcagtccattagaaaactgatacccatgtggtgccttggtattgacaggtttcctgtgtgtgacctaaaaccattctgcattttcatttgtcaggttttcccgtgtgctctgggttcagagcaaattaacttccaagtcaacagaaccaccgaagttctgcttgaactaaagctaagctactctactggtgtggggggagggaggatgttgatcattagaggacaagggcaagttgagaaattgttctatatttcagccagttaattatcgcagcttcccagcatgtctgcaaggagaaatgagaagaacatcaataagtgattattttctttcattattctgttcacctgccatttactgtgcacgttccaggggaagggagattagcaggggttaactttaaaaaatcagagtcccagaggactcacaaaggcatgctgtgtctgcctttctggtactgagtgatgagggtgggacagggctggtgctaaacttttggatctatttttaagctttcaggacaaattttataaatacgagctgcttctttaaaaaaaaatccctttctactctaaaaatagtttgctgggaaaaagtttgtgaattgtttattaagactcagaaattcagctgagcatgtttccttataaataaagaaaatcacctcacagctactgtcaaaaagcagatgtggcttcttaggaaagaaacaagatttctgggatgttaatgccaatgtcagaatgtgggagaaaatttggaattttccctcctggcttgctcttttcagaccttctaaattctactcatttcttatgatcaagttggtgtcttgtcccttttggaaagagttttcccaggcagaatgaatggccttagcttctgttcttaccagtacccttagccacacctgtctcttttcctataacactttgttttatgttaatgacaattgctaatatttactgtatgccaggcactgttctaagctcagttcatgtgctattttattttgttgtcataactctttgaattagatactactattctcattttaaggataaggactatggtaggcagaataatggcccctcaaaggtgtccacgttctaatcttcagaacctgtgagtgtttaccttacgatgcagatatggttaaggattttggattagaatcacaagggtccttataagagggaagcacatgggcaacaaaagcaaaaatacataaattagacaacatcaaaatgtaaaacttccgtacatcaaaagatacaatcggaccaggcgtggtggctcatgcctgtaatcccagcactttgggaggccgaggcgggtggatcacgaggtaaggaggtcgagaccatggtgaaaccccatctctactaaaaatacaaaaaattagccaggcctggtggcgggcacctgtagtcccagctactcgggaggctgaggcaggagaatggtgtaaactgggaggcggagcttgcggtgagccgagattgtgccactgcactccagcctgggcgacggagcaagactctgtctcaaaaaaaaaaaaaaaaaaaaaaaaaaaaaaaaaaaaaaagatgcaatcaacagactcaaagtgcaatctgaacaatggagaaaatattttcaaatcatatatctgataaggggttaatatccagaatctataaagaactcctacaactcaacaacaaaacaaataacccaattcaaaatgggcaagggacttgaatagacagttttccaaagaagacataccaatgaccaacaagcagatgaaaagatgctcaacatcactgaccatcagggaaatgcaaatcaaaatcacagtgagattgcacctcatacccattaggatggctgctataaaaaaagaaaaaacaacaagtgttggtgaggatgtggaacaattgaaacctttatatactgtcggtggggatgtaaaatggtgtagctaccataaaaaacaatgtggcagttccttgaacaattaaaaatagaattaccatatgatctagcaattttacttctgggtatatatccaaaagaattgaaagcagggtctcagagatattatacacccatgtgcacagtagtattcacagaaggcaaaaggtggaagcaacccaagtgtctatacaacagaatatcattctgcctcaaaagaaggaaattctgacacatgctacaatgcggttgaaccttgatacattatgctaagtgacagaagccagtcacaaaaggacaaatactgtatgacttaacctatatgaggtatctaaagtcaactttacagagacagaaaatggactgctggttgccaggagctggtgggaggggagaaaggagttgtttaatgggtacagagcttctttttcagttttgcaagaggaaaagaaatctgatgatcttttgcacaatgtgactgtacttaacactactgaactgtgtagtttaaacctgttaagatgttaaattttatgtaacgtgtatttaccacaattaaaaaaaattttttttaaaaagggaggcagtaagatcagagttagtgatgatagaagcagaggtcagagagagagcgagcattgaagatgctatactgctggcctcgaagatggaggaagggaatacaagctaaggaatgcaggtaacccctagaggctggaaagggtgggagaacctcctctcctacagcccctgaatgaatgcagcctgccaacacctccattttagcccagtaagacagtttctggatttctaacctccagaactgtgagatactaactttgggttaagtcgccaagtttttggtaatctgttagagcagtggtaagaaactattactaaggactattcagttcagagaggttaggaccttgtgcatggtcacgaagtgactggaactctgattaagagctggagctggccaggcaggatggctcacacctgtaatcccagcactttggaaggccaaggtgggcggatcacttgaggtcaggagttggagaccagcctggccaacatggtgaaaccccgtctctacttaaaaaaaaaaaaaaaaaaaaaaaaaaaagaactgcaaaaattagctgggcatggtggcacagcctgtagttccagctattcaggaggctgaggcagaagaatcgcttgaacccgggaggcagaggttgctgtgagccaagatcgcaccactgcactccagcctggcaacagagcaagactcagtctaaaaaaaaaaaaaagagttggagcgcatgtccactccactcagagttccagccttcctagatggtgagaccctaggtagcagtggccatctttaacactacccccgacataggacttgatatatattaaggcacttagtaattgtggctaaaagatttaatgataatgcaccatcgccttttattctgttcccctgatgctgtgtcctagaagccatagggttaaacctaggaaaaggctttttagaaaacgtttcccttccctgtcattgtggggctgctaaggaatagtgtcctcaaggttttagtgtcacttctgggggcctctgggtatttgttgccaggtcccatgatggagtagagtcaggagtgcttatagaatccagacaggggtcagagtcaggggaaatttggatcctgttcttggtagatgggcagtctgttttgagaagaaatgaccaaatttagtcatgacctgttaacctgtttattaacattatttctctttaagctaaataaacgcagatatttctaagcacaaatgaagaaatttctgtgttagctctgatcagtgggcatttcccactctgaaatgcttcctcacccccaaacctaagctttggaaaccaggctcctaaaatcagggccttgtaattccccatgtgagttattctaaattgggcttctgggtgtttctttttttgaagtggggagcaggtgggaaatgagaggccttctaataatgtgcattaacttttgccataaaattattagaaaaaatgggtattttgtactttttttttttttttttttttgagacagagtcttgctctgtcacccaggctggaatgcagtgggcaattgtagttcactgcaacctccacctcctgggctcaggtggtcctcctgcctcctgagtagctaggactacaggtgcatgccactgtgtccagctagtttttgtgttttttgtgtagacggggtttcaccatgttacccaggctggtctcgaactccgtacctcaagagatctgcccaccttggcctcccaaagtgctgggattacaggcatgagccaccgtgcccggcctactttgtacttttaaaataatctttgagtgggaaggcctttgcaatcatgtcacaaatctgaaagacctaagggaaaagattgattgattttactacatagaaattagagacttctgtatggacagagatagaattaatagaataaacagacaaatgacaaacaggtaaattctgcaacacatatgacagccccaggggcacttcttttatatacagagagctattagaaatgagagggaaaagcaggatgctatgtaggagaattgacaaaagacatgagtaagctcatcacagaaaaagacaagtggataacggtaagcatatggaaagctgttcaaccttattttttactaattaaagaaatgcaaattaaatatcatctcctgttatcagattggcaaaaatgaagacatttaaaaatagtatggggaaatcagctctcttccatgctattggtgggagtgtaattgataaattttttggaggccagttttttattatctgctaaaagtaaggatgcaccaagttgttgacccagaaatttcactctagggaatttgtccctcagttgcctttgtggtatatgtgcagagttatgggcacagtgatgctcaatgtagtgttgtttgtaatcgcagaggacttgagacaactgggtggtttcatgtgggttatagttctgtgagaagagaactatctcctacccagcaagattcaaataagttacccgtttaaccagccaaggatacagaaatttagaaaggagattgcctcaggcaggagcgtatgaggtatatataaaaggtatatcccagataccaatctccactcgcaggtttccagtggtctaaatggcaagggagattttgccagatctcagaaacagccaaagtttgctgtgccacaaatcttttttccatgagcatttcagaagagccaatgaggacaactgttgtgccttcatctgtggtatggtgacaaataacgcagctcacctgattcaccttgcctgctgcctagacagagccgatttatcaagacaggggaattgcagtggagaaagagtaattcctgcagagctggctgtgtgggagaccagagttttattattactcaaggaattggaatttttaaagataatttggcaggtagggcttgggaagtgggtagtgctgattcaggtcaggttggagatggaatcatagtgggggtcaaagttaggtttccttgctatcttatgttcctgggtgggatcgcacaactggttgagccagtttaccagtctggatggtgtcagctgatctagtagagggtctgcaaaatacctcaagcactgatcttaggttttacagtagtgatgttatccccaggagcaatttggggaggttcagactcttgccaggagctgcatgacccctaaactgtaatttctaatcttgcagctaatttcttagccctccaaaggcatactggtccccaggcaagaagagggtcttttctggaaagggctattatcaattttgttttacagtcaaaccgtaaactaaattcttttccaaggttagttcggcctacgcccaggaacgaacagggacagcttaaaggttagaagcaagatggagtcggttaggtctgatctctttcattgtcataatttcctcagttttaattttcgcaaaggcagtttcacttccgtgttccaaaatctactttcagacacaaccagactgtcccttttgatactggtctatcctacagttggattctgtgcagctatgaggaagaggggcaaagctctgatggagaagttgtctaagatgcattgttaagttgaagaaagcaagttgcagtatagcacacatagtaagagtccatttgtgtcctcttgttatgtattttttggaatgaacatgtatacctttaattattaatttttgagtggttacccacacacagttttgaaagtcatatgctgctaaaagatgtgtgagtacccagcagcctcttgtcccttctctttgtgtccttatattctaggaggcagtcgttcttcagttctagctgttgcttctactatttgctgctgtgcttctgaataatattcattgctgctctcttggtttgtcgattctagatatgatctcttaactatcatggtagttgaggacttcagcttttctctatatgcacatatctcaggttttgctttaatctatacttaatgttttcattaatgtagcaatgttgatattgaatattgaagcaagaatatactataattaacttacgtatatagctttatttctctctctccctcctttcctccctctctccccatctccctctctccctctctctcccccctccctccccactctctcccttctctctctatccctctctctctctgtccttccttcctcttcgtccctccctctctctctttctctctcccctacttcctctcttctctctctctctccctccctctctcaccaccatctccctctccctccctctctctcttccccccctccctcctccttgttttcttctcccccctcccctcccccctctctacctctctccttctccctctcctggaaaaacaccagagccttccaacctcctgttccactctgctgcccagctgtcagccaggaaattcccatcacacctccgccgcctcctctctctcattgactgtcctggatcttgcgtccttctctttcttgttttactcatttgacttgatggaatgcaccctccagtagccttctgagggagccagtgcacggcttcaagtaaattttttgaaacttcttcaaaaccaaccacactaggagttgcatactaaaaagtttttccttttagcattcaaccatcccttcttagcccctggcccatgtctgttggcaggtggggttctccctcctactgatggagccagagaatcctgggacccagaggctgtgccattattcacaagatcttatttaatcttcagaatggtttgataaactaacaaaactgaggcaccaaggttacgctctcagtggtatcagaaccaggaattgaagtgtcagctgcttgggccaggctgatgcctttcctaatctagctgctccttactggaagaaggaataacagtaccatgccccaagtgacacatgccagatgcatgtaaccatggttacagggtgagtccaattctcggtgcccacttgtgtctggttcctgacaacttcagctctagatagccatccttctctctagaagtaccttccagtatgtatgtatgtatgtatgtatgtatgtatgtatgtatgtatgtatgtatttatttattttgagacagaatctcactctgttgcccaggctggagtgcagtggtgcgatctcagctcactgcaagctctgtctcccgtgttcatgccattcttctgcctcagcctcccgagtagctggaactacaggcgcctgccaccgcgcctggcttattttttgtatttttagtagagacaaggtttcactgtgttagccaggatagtctcaatctcctgaccttgtgatccacctgcctcggcctcccaaagtgctgggattacagatgtgagccaccgcgcccagccaagtgtgtgtgtgtgtgtgtcgagagagagagagagagagagagagagagagagagagagagagggagagagagagagagaggagagagagagagaccgagactgatttatagttatggtcctagctccttatggtaattaaaatgccctgcctatgatttgtgtaaacttggtgtgattatttttattgctacagtatttggttttaagcaatgtaagaatgtcacccccctcctcccattccttttgtgatgtgaaatgcttcattacttaggaatttgctgctgattgtacagtttagcatttgatctttttgttaaccacagtcaggtgaccacacatagggtaattagattaacccacccctcctcttctccactgaaacaatgtaaaatccaatattctattagcacatgccttccgtagattaatgatcttggagttgctgcgtggaaatttgcatagctccctacagctctaagaaatgaaaatgcccagctgtctaaaagctttaatcaggaaatgagcatgaaatggcattgttttgtcacgggcttggaataatttattcttgacaatcgagttatcctggatataaatgtgtataaacattctttcaacaaccagtaaacaggtgcttttttgttcgttaaaaagtcaagattttcttgacttgggcttggctttgaaatcgttggccctcgtgctggtcactgccaaaagtttatactaaagtcattttccttgtccctcctgttttaaatggcagtttctggaggctggcctttcagagcaagaacggtcttagggagtgaaggaatggggacatggccataggaccacacggggtcattcctcacccagccccttcttgcctgtgttttcatcccctcttgggacctactttcccctatctgtcaaatacaaataataatggcccctatctcttaatgtggttgtgagcattaaatgtgttatcccatgtaaagccttagaaaagtaccttgttcatggtatattcttcataatggcgagctaattccataagacatagggaaatgaagatgcaattctgtttctttttctatttaaaatatcctagtgcacttaaatttttttctgttagactattagtcttggaagcaattgtgactataaatgctttcatttatgttggcacaccgttaaaagaatgatagaactaatgataatggctaacattcattgaatgcctgggagtgaaagactgaatgaggcctattcctgactcttggggctagacataaggacccatgcttatagcccaggggtgtgtgacaggctcttactcatcatcaaagctgttaaaaagacagcagaaacggcccttggaccttggatgttgcttcctctttttttctcctccaagagcaagctttttatctagcacgtgatttaacagttcctgtgttgggggtactgtttcatggactaggtatgatgtagtgagaaacattttaaaatttttccagaggagactttgatgggaaaaatgcccatccctcaggggactcaatttgagatcgtgtaattaaccttttggagcataattagccaaactgtttagctctttttacttgtactctgggcaccaaagaaagctggatcctacccatgataaaactatcatcaataagatttaatgttgcctctttatatgcattttatttttcttgattgtcatgcccttagttattcttgcatttcaagaatctttttttttttttttttttttttttgaaacgaagtctcactctgtggcccaggccggagttcagtggtgcgatatcagttcactgcaacctccgcttccagggttcaagcgattctcctgcctcagcctcccgagtagctgggattacaggcacgtgccaccacacctggctactttttttgtatttttagtagaggcggagtttcaccatgttggccaggctggtctcgaactcctgccctcaggtgatccgcccaccttggcctctcagagtgctgggattacaggtgtgagccactgcccccggccttgaatcttgaactttatatcacatgactgaaaaaaaaacattgattattgggttttgcctgattttccccacatcttagctttcctgtctcccctgcttaatgaaacgtatggactggagagctttctgtaaatcttttgtgtatgttagcatacactgttggatctttaaaatcagtagtggaaattatatagctaaactcttattggggggcagtgtcaacttcttccttgtgtcaatcaagaaaaatgatgagacaagtctcaatcattttaggaagtttatttgccaaagttaaggacgcacgcccgggagacaggtgctatgcctttctctgaagatgattttgagggctccaaatttaaaggcgaaagggtgggatattgagaagtatacaattttcacataagaggcgggtagggaaaaatagttattcatgtctttgtctggctcggtgaatctgcttttttttttttttttgacataagataatatagacaaatggggcagaggaaaaatgcagggaatctgtgtttttacataagataacatagacaaaatggggcaggagaacagtcagatatgcatttgtgtctggtgagcaggggacaactgcacctgtaaagataagctatcaatttacattgccatggtgaaatcttaagagaaacaccttagggtaaagaccttggagctcactaggaatttccttgtgggtaaaatatggggtaggcatgtagtttttcatcttgtagccattgtattcaggaaccaaaaggggaggcaggtttgcgtgacccagttcccagcttgactttttcctttagcttagtgattttgggaccccaggatttattttccgttcacacttgtttgcaaaaaaaaaaaaaaaaaaaagcagtcaataatttaacgatcaggaaatagtaaacatatttcaattactcaatgtttaagttaattaaaattttgaatagctaacacaggcatatggtgccagctaaaagggacaaaatatatgctttctctgtccctcggccacctggttcccctccctggaggcagcctcagttatcagtttattgtgtgtggcttctgtattacacacagaggcgtacatacaaatgtacacaaatgctagcatacgttaggctttttttttttttttttaacctagcaacatgtcttggtgattgtctttcttggtacatacagactgacttcagtcttggagagagttgcatgggattgatttatggccattcatcagctgctctctactgatacacatttatgttctttcagtcttttgctaatttaagcaatggcataacgattaatcttgtacatatgctgttttgcacgtgtatatttgtagtttaaattcctaggagtagaaatactgagtcaaaaggcacagacatttaaatttttgatagacagttgtcaagttgcttcccacagaggctgtacaaatttatttatcaatttatactctacttagaaagtatgtgaggctctctttccctacacccttgctgacattatcaatttttttaattgttgacaatctgacagataaaaatatctcattgtaatttaaaaattaggtacatccctccctaaactgtcaaattctggagagatttgttcttggggtcctcatagcccccattctttgagaggaccagctgtgtgccaggcactacgtcacatgctgtgaaaacaaacagtattctgagagagccagattctagtgcgaggacacatgtaaacattattataatatagtatgtaatatatactatagtataatatagtatgtaaatgctacaattctaggtatgagaaaatagccggaatgatacagggtccttctgtgtactgagcactgtcaggcactgttgtacaggaataccactgtaattttcatttctcttgttgtaccaggacaagccgcagacaaaactcctcagacaccgagttaaagaaggaagtggtttattcggccaggagcatcggcaagactcctgtctcaagagccgagctccctgagtgagcaatttctgtcccttttaagggctcacaactctaagggggtctgcgtgagagggtcatgatcgatttgagcaagcagggggtacgtgactggggactgcatgcagcggtaatcagaacgaaacagaacaggacagggatttttacaatgcctttttatacaatgtctggaatctatagataacataaccggttaggtcaggggttgatctttaactaccaggcttaggtcaggcaggcccaggcctagtttcaggtctggttcctaggcgccaggctacctgcctttagtttcgcttctctttctttttctgagtataaaacagtataaaacaatatgagacgttctgtctctcttctctcatcgtgaatgcagttaagcatcttgttgcatgtttgagtcatttttttcttttttatgtgacctgtcctttgctatttttttgttgggttattgatcttttgctgatactttgtagaaggagctctctttatagaagaggcaacattcccccagtttgtcttttgtcttcgttgatgaattttgtcgttgttgttgtttgctatgttatattcttagttttctgtaatttatttttatttatttatttattttgagacagagtctcgccctgtcgcccaggctggagtccgatggcgcaatcttggctcattgcaacctccgcctcctgggttcaagcgatgctcctgcctctgcctcctaagtagctgggattacaggcacacgccaccacaccctgataattttttgtatctttagtagaggcagggtttcaccatgttggccaggctggtctcaaactcctgacctcgtgatccgcctgcctggcctcccaaagtgctgggattacagacgtgagccaccgtgcctgccattctgtaatttattgaccctttcttttctagcttctaaattctgtgtcagagtgttaaattatctttgcctttctgagattgtagaaacattctttattttcttctagtgctttaaaggtttagtttttaaatgagtaaattcattttgaatgtctaatattcccagttaaataaagaaataagtattacttgtttttttaaaaaagttagggactacatgaattttcttactgtatcatcttctcccctctgctcctaagcctgatctgcatcttttaaggtgagaagttgatggtgatccagccgtatctttatagggatgatacagatctccatgttgttgcagctttgggctcaattgagaatattctgcctctgatcacttgaggtcaggaattcgagaccagcctggtcaacatggtgaaactgggtctttactaaaaatacaaaaattagctggatgttggtggtgggtgcctgtaatcccagctactaggcagactgagacaggagaatcgcttgaacccaagaggcagaggttatgacagagcaagactcctccctacgccccaccaaaagaaagaaaatactctacttcatctgtagacagccatcttgcccataacactctactaaattggtcattcatctgatagatatttttaagtatccaaacaactggttgatattgacaccctttgatccagtggtaataatctagatgtttagcggggtgtgggcaaacataaaggcaccaactgtcatgcaagtaattacactgtacatcgggaagcaacattatctctttgggacacaaaggtagtcgttctcatttttgtccagtatctgttacttgttgtggtctttatagtgttcatccctttcctgaaggtcaagagcttcttgcccttgttctcatgttcttgttattttcttattcgtgttatgagtgattcttgggagataatactgcaagtatatgatattgcaaatatgcagttaaagattgacatagaacatggtaatagacctgttacatttcttgaaatttccttgttagctttgagctgaaaataccatcagaatatttatgagtatatatcaaagcacttttctgagcatcagcatattttgtaagtatgagaaagccattgtggtgtgagacatcaacgtggttctgctatgtaattttagggcaaattatgaaatatgtaaagcatataacaaatacctatgtgcccatcacccttgctttattaaatcctcatattttgccatatttactttatgttttttttcttctttacagttctaatgaagttggtgcacttggtggtttgatagcatgggtattttcttttattgtggtaatcagatatattttttaaagaaacagaatcttaaagctacagctgaagctccccttggtagtctgccatattctcagaatacttgctgtgtcttcccaggtgttctgagacagaccagccttttgtgaagagagccaaatactgggaaggcacagtctctgcacgaagggaacatactcacggggcagctgttcctcagacttgccttttgcgtggggtggggtggggtcaggggagagatatgcatgttggggaacaatgtgctattctaggtttctgtgtctattcaaagctgtcttgatcagtagacttggtaaaagtgtttgtttttagtgatttttaaaaatctcctgccagtggtaattttgcaaaatggttttctatgaactagtgcagggggcacagctgtgatcctgcagccacgtctgggtctaaaggaagcctttcctgcagaaagcaatagagcaggactgagggcaggctgatgaatgatgtctgtttcccctgccctgcttccaccctaagccaagggggctctgcccaacctcactcagctcttcaaatgcagagagaagtaccaggaccagcattctgggcagatcagggtggtgcccagctttccctggtgtccgtggcaccagcctgctctgtgtgccaatactgttggtgacaggagagagagaaatctggcaagatagggggaaaacagctgaggtggagaacaaggatgccctcttgggaacagatccattcatctgattgggtaggtgagatgagacacgcatggctcacctactccatagggtgcatctggcacattccgaccacctgccccattgatgttgatcccagaaaacatctcaccacctgagatgaacattaaaatacccaagcactagctttgtgtatgtctgacctcctaggagaaaatatcagcacatttcaatttaaaagaatctgtcttctttcagtttaagcatttgtgctgttcttttaaattgaaattgcatgcagtgaagtgcagaggtcttagaagtacagttcaatgaatattttggtctatgtacacctgtgtaaccaccacccagacctcgttataggacattttcatcctcccaggagactccctggtacacctccccaagtgtaactgctgttctgagatctctcaccaatgattaattttgcctgttgttgggtttcacataattggaatcatacagtacatcatcttttatgtctggcttctgtcattcaacattatgactgtgaatttcatctgtgttatgtatagttctttttaaaatagtatttgctatttaataatgagagtagataatcaatttgtatactactctctaattcactctttgatcctgaagacacctctcggatggtgtgtttgttgttagacctcttttacagatgacagaagggctgcatagagactttaagtgttgcccccaaggtcacacctcagataaatgatgacgtcagtactagttctggttttctgatgcacagcatcattctccattcatcgtgaagcctgtgccttaaactgtgttatgaatggtgaaagaagtaaaggatgaaaggagggaggggcccccaaactgatcatattttggtattttactgtgtagtattttggttacagactgaccagttaatttaaaggagttaacactgaacccagccaactcaccagtacctgtaaagtatgaaacggatggtgagggagaagagaaaagaggtagccaacttggctcagcagccagccagatccaggcaacgcagcttatcagaaagcagaccatcctagcatagctcgcagttgcatgcacatcatctgtttgcccggtgaggctgctgtttgcaggccgctgaatgtgtcgtgaatttttgccagagtggcattattctggctttttggtctctgaatgtgggtgagccatcccaggctctgtttggtacagtgcttttgggaagggaatggtgtgagttctcttccttttctcaagtggtccttgtgacacagctgaagcgtcctttgcagcattgataccttattgatggcctcggttttattgtacatgctgagtttccattgtaaagagatcagatctgagataaagagaagctgggtttcctttgctttctgaagaggtttgctgataccctgtctgttctatattgtctttaagcaagcaaaatcattgctgatttatatatgtgggcagttatgtatgcatttccatgagccctcatggcctgtaattctggtccagggtgtggcctctactactgagattataggacccaggttcttaacaaatggcaaaaaaacacgggcctgatggtcagaaagttgcaattaaagacgggggtctaggaacccccagtcccaggaaatccagagtcccatgacctggatcagaacctcggagagctccaggtacttggctgttggcagatatacagaggcaggagttgctctagttccaagccaaccctcctctgcaggaaggagctcttctatgtggatggataataagggacttcaaagatttgggcctcaatagtcttgggctttataggtaaggtgatctgttacatcacttaactgtggagggaagctaaggtttccactggagccacaggctgagtggttttgagtctccctcctatagtcatgccactggttcttcttaggaggtgagatgtactaggagagctctgcctagaaggctcagagtttggtttcatggccagctctgccccttgctagctttgtggccttcatctgatcttgcatcttctctgactgggtctcactattcttatgtataaaaatatatgtttggcaaaatcagttgtttttttttttcctgacagtgttgttgttaggaacaagtgaaaaaatagctgctaaagcactttaatttataagcctttgccagtgtacagttgtatcattgctagcatcatcacctatttttagagcctgtggataggaatccatgacgtcaggattctgtgaacataaggtgttgtccaagcagtgcaccatcccccaacttatatttgcatggtaattggttctgtggggtcagcatgcatgtcacatatttttagtcagaagcaagtacacagagacttgtggtttgctgttcaatttgaaaagtgtttgaatgaaagcttgtcctgtggtcttttggaagtaactggagatttctgtagggactgacaagaacaacagacgtttgagtgtccattttgcagaggctaaactgggaggggagagattgtaggcaggaagacatgattataatccaggcagtactccaggaaacagtggttaagagatgagctctcgcctgtaatcccagcattttgggaggccaaggtgggcggattacttgaggtcaggagcttgagaccagtctggccaacatggcgaaactctgcctctactaaaaaacacaaaaattagccgggtgaggtggcacgtgcctgtaatcccagctattcgggaggctgagacatgaccattgcctgaacccggaagtggaggttgcagtgaactgagatcacgccattgtactccagcctgggcaacagagtgagactgtctcaaaagaaaaaaaaaatgagagagatgagctctgaagctagacaggttgagttccaatcctggctcctacttgtctgaccttgagcaagtttgcttagccccctgggtcttgtgtgggtgtctgagtagggccatagtgtagattaaaagttgcagtccaggtgaagctcttagagcggggtttggcacatggtaagcactcagatgttagctgctattcatgtgggagtcttctattcattttattgtggtaatatatgtaacataaaatttaccattttagttattttaagtgtacagtcagtagcattaattacattagaatgttgtgcaactatccgtactatctatgtccaaaacattttcactactcctgagagaaccctttaactatcaaacagtaacttcccattctgcctctcccaacctttcaggtaacctctaatctactttctatctctatgaatttgcctattctagatatttcacataggtggactcatacaatgtttatccctttgtgtgttttatttcacttagcataatgttttccaggttcatccatgttgtagcatgtatcagaactttattccttttcgaggctgtataatattccattttgtggatataccatatcttgtttatccattcatctcttaatggacacttgggttatttccttcttttggctattatgtataaagttgcagtaaacactggcatacaagtttgccttgggggcaaagctttcaattctgctggggtccctgctttcaatgcttttgagtatatacctagaagtggaattgctggatcagatggtaattctatatttaactttctaaggagctgccatactgttttccacaggagctgccctattttacattcccattagcaatatacaaagattccagtttctccacatcctcatcaacacttgttttcttttaaaattctagccatcctagtaggtacgaaagggtatttcattgtggttttcatttgcatttccctaatgactaatgatgttgaacatcgtgtcacatgctcattagccacttgtatgttttctttggagaaacgtctattcaagtcctttgcttggcatttatatttttttccctttatgtttttaagatactacaggaggacaaaaaagaaacagattgagaaagtagatgcagccagactgggcgactgcttagatagggggataatactgaattttctactctgggtaattgggtggatgatggggtaccaaagaagacaggctgccctttcctgggagaaggggcaggttggagaaaaggtattggctttgggtggggctgcattgagcttgggtgttatccaggtggggagcctatagaattaactgccacggccatgtgtccgattggtttctctgaaaaaaatgcaagacatattttaggttttgtctcctccctgcttccacctaaagaagcaacttaagcaattcactcatcattcagcttctctatttggcaaatgtgaacaattactgggggaacaatggagtctggaatttatgggccagcctctctcctggtgccagtttctcagcccttcagcacctgctcttgatcagacccagtccttcctagccagctgctccccacgtgctgctctgaagcattggggagtaggggtgagccttcttgagaaccatggcttctgaggctttctccagggaccaccccagcctcacaatgctggcgctgcttctcccacccttccccggctgcatgccattagcagttattgctaagtagacacttgctatgtcgtcctcaacccactgactttctctgagttactccttggcaaagttgggtgttgtgctctgttgtgttactgcatcacgttgtgtctaggtggggaatttgcacgtgcacagtcatacccacactgcgatggaaaatgaggtttgagcaactgttcttcccccaaagaagcaaccggtgaggaaatgagcccacttggtggcttgttgtctttactttcagagccagagcaggctggcagccatcaccaagttagcatcctgtcatgtggctcaggcgggcaatgtttgcagattgtcccctgatgccatctgcctgtgaggctacaggaacccccagcaactgctgctctagcaggtgctggggctgctgaggtaggtgtccgtgtacatatattcaagcacacacagctttgtgtggtgtgcagaggtaccggtgttgggctagggctgagcttcgcctagttaggcctctgggacgccagttgaaacactcaacctagcaaagcgccagccccagttgttggtttccggtggggccctggtgagggaggaagagagggtgaggctgctgtgaacagaggcagcaactggggaattggatatggtaactaacacactcttgagtgtgcaggaagctgcggggagtggcattgttttgacaaacttttgttgctttctttctgcctctgccctctgctcgggcctagtcatggccctctacccaatttagcatctctgttccttccagcggggagcccatccccatttcttacctcatgggctctttttaaggagcgcattcctcatctttgagctcttcctgccattcagccatgctttgggtcagcccctaagctttcacttttccccaagttactgtgattatggattcagacaagcctagaaaatccttactcctttggggggaattcctgtatacagacttatactttgtgagtcactattatcttggtctaataatgctttttaaaacaattatgtaaattattaaagcaatttgaaataattatattagccatcagatttcagaaatctagatcttaatggagctttgattaagagtctacctagagcaggggtcagcgaactttttctgtaaagggccagatattttagactttgatctctgttgcagctactcagttccgctggtgtagcatgaaagcagctgtacaaaatacttaaatgcatgagtatagttgtgttctaatgagactttctttacaaaagtgagtggtgagctttcatttgctgacccctgatctagagtgataagccatccttattttttttctttgtcaagagttgaaaagccagaggaacttgatgactgtaaatgcattagaatcatcttcttttgggtttagtatccttgtgagcacaatggtaatttgggaatatgcttctttaaatctctgttgagaagaagataaatcagaaggctttttaagggggtgagtctgcttggccaaagcttgtcattgtttaacaagaacaggctgtcacttagagctgtatggtggcttttatgtttcactcattctctttatagtcacatggaatggccatagttacataaggtcgcctcaccatactggggcttattccactttataggaccaggtgcttttctaataaatgtaagaaaactacaaagatacagaaaatggtgtttttaaaacatgatgttatgctaagttggcattgctatagttcatttccagaaagatggagcttaagatagtccaagaggcattctaaagtttcaaactataatcttgttttccttttatctgtcctcacaggaaataaagaaagagatgaagaaagaccctctcaccaacaaagctccagaaaagcccctgcacgaagtgcccagtggaaactctttgctgtcttctgaaacgattttaagaaccaataagagaggtatggaaaaggaaaaagaggttccctccctgcacacaaacaaaagctggaaacttctggtgaactgtgtcaaactttatattgctgaaaaattgaatagagtttgtccttttggtttttggtatatattttggatacacacatacatacttggcaagtgactatatgtatagtaactgtaataaagggaactaataaaaatattttttgacagtgggaaagtagactacatttgtaaatgatgatttttctggagctgtagatttcactttcatatctatttttatggatgaaaggtgaatttagagaatgctgtggtgcaggcctgagccgtgtgtctgaccgcactctccctttaatttaaggcaaaccttatcaagttatttctctctccaactgctaggctccctagcgcagaccctgcctctctgagtttgtgaggcagaatgtgcaaagatatagctaacacatctgtctgaccagaagacctttaacaatcttgttttctctcttttgagacctcaaggcagattttcaggtatcagcttgttggagttttgttttttctcccatcccctcttggtgataattgtttgaaataatgtgagagagaatagaagactgcagagacgaccccactcaattttatactgtgagcacactagggtccctccgtttttcctgaccttggaccagccagggcacatgctgagcatgcctgtaggttagcgcttggctgccagcttttagtgggcttattacttccttaaagagaaatagagagctgtttgaaagcaggcacaggaactagattagcaaagggttccattaaccagaaaaaaagaaggcaagtttatataaccatggggaggaagaacagctaatctttcataaaatttagacaggataagaatttgtccagtaaactgcccattgatcatagctttgtgcctctcttcctttctgtctcttcctctactgcctccagctgccctgggttacatttccctttttgaattattcagatcaaatattggctggaggcccatgttggttagcagctataggattttctttcttttctcgttttgttaaattcatcctaccaaagcaggggatttcccattttaagaattaagtgccctttgctgtaaaactacagtcttgcccaaaagtgcctcctgcattcttgcaagtaagctctcaaactcctgagacctgcattcattggatttggtgaggtagagttcagtgtgtgttctttctgcactttcaaaccaatgagaaggagccctcccattcctccacctgcctcttgggtccgcgggcacggcaattgcacgcatgttgaccagcggcaaggcctctttggccagccatggtttttgtcaagtcagtaagagatttaaagtaattaattaatttaacaagataaggaattaattaaggtaaggaattgaggtaactatttggatgagtttagtaaaattacctgagaactttaaatcaacgaaggaatagaatttttcagatgattatctcttcaccactgaaaatctggcctctgagttcccctatggaatttttcattcaccaaaaattggaatgcagagggatggcttactgccttacattccattttgaaagctttctgccttggacctgcagcctggttatggccaacctttcattctgaggcattttatatgtggaatctgccggtggttgtgggacctgagtacatggaggcattctgtaaatatgaagtctataacaaatcatcttcattctgtccgaggcttcaccctgacctcctgggtcacctgggcgtaacataaatttccagctgaagggaagcattgtgtaccaggcccagggctgcctctggccctcccccaccagtcaagactaccagtattctgctaccccttataataaacagcgggggtagattgattggccttgtcaggccagataaatagttcattgtactgagctcaaaagctacatttttttcccacccaaaatcaatgaaaaaaacacttttttccccccttaaaacaaggatcagaggctaaatctgtgggatgattctagttacttgtaaacacttcggtccaactaatttttaaagttttatgagttaccataagtgactgaaggggcctccttcccctttgtttccatcatcgagctttgtctccagcaacctttcggatgttttggtctattactgttgttgtggctattagggaaggaagttgctttcaggatttattaacagcctgctttgattggctaacatgggatcttagaggatatgagttgagtccaccttgtgattcagtcttggacccttgtaagaatttaatagaatgaacacaagttctcttccttgaacttgatcaaagatgagatgactgttttctgtatatggaccttatcatttgatacatgcttgaagttggattaataatgaaagattgacatctatttctatcatgagtctgaaactgaaccacttcattgggtcctgaacttgagatagtcctagctgaagaagtttgcccaattgtgtccagctgtttttgcgtcttgtgacatgcctcactttgcagcaactgcaaacaggtagtagtccctcacgttgtgggatgagctcaccctccccagacacctgcataaggtcagaagacatcttgggtttgaaggaagctattcatagccttgagaaaaagccagggctatggaaaccttagtttggggactgattagtttcacttttcagctttaacgtttgtaaacgtctgcagagttgatttagggggtactggaatgactccatgggctttttttttctttctttctttctttcttttttattttttggaaacagggtctcactctgacacccaggctctcactctgacatccaggctggagtgcagtggcgcgatcatggctcactgcagcctcgacctccccaggctcaggtgatcctcccacctcagcctcctgagtagctgggactacaaggtacgagctaccacacctggctaatttactgatttttcgtagagctggggttttgccatgttgcctagctagtcttgaacgcctgggctcaagcaagcctcctaccccagcctcccagagcactgggattacaggtataagccactgtgactggctggcttttcatttgagaagatgatgtgactggaattgagagagagaaagtacatcctcccagctgacttggcagccactggctacacattctggcattagaaccttaggggcacttgtgtctgcactcacttctggccatttctgtggtccttacctgagtcacagtgaaagagcttcctgtttaaaacaagcctttcctgaggaataagaagtcgtttttcatttaaacttgcagcatggatgttgtatgttctgaagttatcccagactccagtatatcgatgagttaagccagaaaatgtgaaaactttacttggagccaaatgtcattctcttgatgaaccagacagaaaagagttgtatgttttcttcaaagaatgattgattcttttgtttcttctatcattaaacccataaaagagaatgatgggccctcctaaattggagcattgatatatagagacttttttaaaaaagcattcaaatgccgagattgtgccactccagcctgggcaacaagagtgaaactccatctcaaaaaacaaacaaacaaacaaacaaaaaaaacgcattcaaatgttgagtttagaagaaaaattgaataaaacggaagtttgaacagttagcatatatcctaaataggttcttgaaaatgaacagtggatttttgtccatttgaatatagactcttacctacttgaattaaaaatgaaataaaaaaatcaagctggacacagtgactcattcctgtaatcccagcactctggaaggctgaggtgagaggattgcttgagtccaggagctcaagaccagcctgggcaacatagcaagaccccatctctaaaaaaaataaaacaattagctgggtgtggtggcatgcacctgtagtcttagctactcaagaggctgaggtgggagaatcacttaagcccagaaggtcggggctgcagtgagctgtgatagcgccactgcactccagcctgggtgccagagtgagaccctatctcaaaacaaaaaacaaaaaaaagaaaaaattatttgatccttagaaggatttcctggctaactttattcatgtgatcagttaagtatccaggctgtcatcaataccctgctggcccgtgtgaggaccaggttccatctcagggttctcgtttgcactgttaacagtgcatgcagagaagatgtatctctgcctctctctgaacctctcctgttgcctggaattttggacattgttccttcctcactttttggtagacacccatgaacattcaatagtacatgtttagtgcatgcccactatgcatctgcccttgtgcttggtgatggggcagataaagactggaaaaacaccagccagtcctgcctgcaagtaactcagtctgttgtatcccttgggaaacgttgagaaagtgctgcacgtttcttatatcattttgatggcaaggtggggatgtgtcttgtatttacttctgtcattctgaatgtgaagccactccgtgggtttctggttggctttatatgtccttgtttctatttccagtttatcatgaattcagtgtttggtaagtctctattgtattttgcacatttactattttttgctatattattatgctctcctgatacaaaatgtattttatagttacctttttaagtcgctctgctactttggcatctgccttcccaaagataaactgcttttaccatctttatttaaggttttttatgcatttgcattttactgccccttccagagattaatgctgaaagatctgacggtttaaaagatgttatttgtaacaggtctagctctgatgctacgaggtgagatcgtctgtctcatgagattcaagttaagatgggggagggttgctctctgaattgatatgtgggtatgactgattgtagaacattgctctgtgggttcatttctggtgtgtttaatccttcagacgggttccattcaaaagttttccttaacagagggatcaacggctgctcttcctctggtgacacactgttgctttaaaagttagtgcagaagttcttccacattaatatggacctcgtgtttgccacatggaagggctctccagtttggtctgctacctgtagctgtcagaagaatgttgcttaatgtttacctttcttctcatagtttcagcactggtcattccaagccctaaacagatctaagtgactgcccgtcctttccccacttcccctgaaggggaaacgttttttctagcttttagtgtgagggcctggaatgcttctcatggcgccaaggcggtggcgtggatcttgataggccgtgagctctttggcagaaatgaaactgttaacaaaggatggaaagaagtatgtccttagtaaagaaaatgtcaacctctttggtttgccagtggtttgttgtttaaggtaaatgtgagatctgggggtttgtttgtagagatgagactttgtttctttcaaattttctattggagaaataaatgtgaattcttgccagttaactgggaatctgaaaatgtgccatttggggtcagacttttctttgagtttcaagattgcctgtttatttgacttaaggagctggtgtttatggacagatagaataagagttaacagaagacattactgttgtgtagaagctcttggctatcacctgagctggtctttcccaggggaaatgaaaatctggcgatctggcagtgaatggggatagatatgatacatagtcattcagtaatatatacgtctgtgtgaatgtatctgtatacgcatctatagtcttattttccagtgggccttcattctcaaaagctctggagtcaagagcctttaaagaagtcttttaaactaactgatccctgactgcatttctggcaagttttattgggacactgcgttgttagcaccagcaattgatgttggagtgtgtgttaccctttttcatgttattttctgaacctattgagcctagagtgaggggtggtgaaatgcatggtaagaactacataggagggtatagccatcatgttgcgattatgtgtgggtcattgataaaatcggtttttagatttttttttctgttatgtttaatctcctttctatctctgtgtcttctgatttcaaggcattaacactaatgagtctcccatgggttagtcatgggtttaagactcccgccatactcctgctggtgtccgcccaaatccacccagaggacaagccatgaagtgggtttgtggtggtggctccacctggtggctctcctaggaaactcctctttctgcccaccttttccttctccttgggagaatcttgatggaggatgcctttgattcctctgactcagtgttcactatttgtgcagttccatcccagacccacggcttctcacattacttatggatttttttagcccttttgctttttcgcctaagaattgctctttgaactcatataatctgtgtcctgatccttgttctatctgtgatacccctatggaccaggattattgttaatgaggattaaaaaaaaaaaaggactcccataggcatgactctagatatagatattaatttggacaaaataaagaatcacactgaaatccctgtaggtatgtatgccaaaatctcctgcctaatagctccaagtacccttatctacttcttcttcactttttgttgaacccatttttcctcaaaggagcaatattttattaccaatgttgttttcaattgtcagcaggtggcgaaagtaaaaagccaactaactttttggcttcattgttgtttcattattgtttgtgaattctctacaggcagcccccttcttgcctgggcacagactgcccccgcttggtatgtcactgagcataagtatttttgataaataaaaatgtcttttattctcattatttttcagtttttagttgttgataatattgcagatatgacttattttagctgcattgtgggtcagtctgggaacttaatcaccatttataactttgcttctatgggaataatgcattcagagttccaaactctctgcataaggcacatataagtctttttttttttttttttttttttttcttggaggcagagtctcgctctatcccctaggctggagtacagtggcatgatctcggctcactgcaactttcgcctcccgggttcaagccattctcctgcctcagcctcctgagtagctgggactacaggcacctgccaccatgcccggccaatttttgtatttttagtagagacgggatttcgccatgttggtcaggctggtcttgaactcctgacctcaagtcatcccccagcctcggcctcccaaagtgctgggattacaggcgtgagccactgtgcctggccaagtctgacttcttttttttttttttttttttttgcattgctgacatgaatccttaagtacctttgtaaaagtcagagtccgtataatcggtgcccactgaagtttgctcatgttgcagaggagtttataattcacacagtatagaatgctggaactgtgcaagctccacacagtacactaggctctgaggatagctttgggttcaatcacattgcaccattgtatatggtgcttattttcacaaggcctgagttggatcttagtgtgcccacgtttgtatgaggcatgtcgtgaaagtgggtcctattgtatatttccatctactagtgacgagaccttgcaccaagcgtgacatgctcagatagaaaccagcccagcatttctcagtgtgtgttgtatggaattatagcccttctgactattccacaaaggagggatgcggggagagacaggcagacaagcggggagagaaaattgcctctctcgtcaaatttcagctgcagcactaacaccatcttggagactgacaagcacattagcatagtacaggctctcagatggcctatggtaaggagacctgcttatctttgatcatggaactgcatgttattggatactagttaagactccactttgggatatgttgggctttaagatacaggacaaggagctctgtaagcatccccaagataatcttcaggttccacctctcatgggaaatgtttgagtaagtgagtggagatggtggtgctggcactcagagaaatgactggcgaggcttcttaagcctgcgctgtcaaaaaacatgagttagatgatgctaggagaacattctttgaatctgaaacttgaaagccagtcctcttggtagtttttcaagtgacaagctgaaagggaattttccctctgatcatttcttgggtccttgtatctaagaatgaggcttagacacatgagtggaagtcctagtctgggctttggcatgaaaagcaggctgaggggacccaacctagcaactggtgaggccagggtgttcaggtctacctgggacttggatcacgatggaacctgcgattccagaggtggtttttattatgatgacagtctctacatagtcaacatagtctcattgccttctctacttgctttgactgaaagacagaagtcttagcttttcccgatgccattaaaacactgaacgtttataaagaagagccttcttctctccctactagtgaaacaggctggcatttgagttcaagtaataaatccacatgtggggttgtgaggaaaaaccacatagcctgcctttttagaattctggaatcacagagttacagaggttacagagggacccacttattgacatcccaggcgaacgaacatggagcctctgcccagggaattgaaaaggacactccttggctctggccttggctaagccccacgtgggagcctcctttccaaagggaagtttttctgggtagggaactgctagattaatgaaaggtaatcaggccaggtgtgatgacttacacctgtaatcccaacactttgggagggcaaagctggaggatctcttaagcccaggagttcaagaccagccggggcaacatggtgagatgttttatagtctctataaaaaatacaaaaattagccgggcatggcagcgtgtgcatgtagtcccagccacttgggaggctgaggtgggaggattgtctgagcctcggaagtgaaggttgcagtgagctgaaatcgcaccactgcactccagcctgggtgacagagcgagaacccgtctcaaaaaaaaaaaaaaaaaagtaattagaggtagatgatatttaggtgctggttgcatttgttgcattatatggggacagcagctatattcacttgcagtaagctctggaaaaggggcattttcttctaattatatctgttgatctgtcatcacagcctggtctctctgatgccatgtgcagcctcagcttagtctttggattcttggctttttgtgcttctgaagccttaagactgttgtacccaaacaatgaggacatttcatggcccacctccctaactcatgattaggccaacagcgggcccagctgcagtgccaggtgggctgccctcattgtttcaaccaggaagggaaagagagaccagccagaagcttcctctgcatgtgcctgtgcatgaaaaagagcatttgaggaggactagcctgcttgtcgcatttgtgtttctctggagacctgaataggttcagtggcagcaggaccttattgcagggaggatggctgttgggaggacccagaccactcctgctgcacctccacagcttctgcagcactttagacaagttgcagattccccctgtgtttccaggtttcccatttgtaaaacaaggaaatgctcttgttaattccttcagggcaattgtgaagattaaaaatgagtaaagaaaataggttttgggatagggaggcaatagagtgaagtggggtagggtgtcactcactgaatacagtagtaattgctattaaaagtagtaaactgctagtaagaccccagagcattgggaaggaattagagatttatggaaaataataaaacgtgttttcatgaaacaacctgtgatcacatgcacatggcaccttctccaggatggaccatatgctaggctgtaaaagaagtctcagtggccaggtgcggtggctcacgcctataattccagcactttgggaggccgaggcgggtggatcacaaggtcaggagattgagaccatcctggctaacacagtgaaaccccgtctttattaaaaacacaaaaaaattagccggtcatggtggcgggctcccgtagtcccagctacttgaaagtctgaggcaggagaatggcgtgaacccgggaggcggagcttgcagtgagccgagatcgcgccgctgcactccagcctgggcaactgagcaagaatccgtcccccccaccccccccccccgccaaaaaaaaggagtctcagtaaatttagaaggattaaaatcatacgaagtatattctccaatcacaatggaattaaattagaaatcaacaatagaaggaaattggggaaattcacaattacatagaaattaagcagtatgctcctaaataaccaatgagccaaagaagaattcacaagggaaattttaaaatactttgaaattaatgaaaatgaaaacatgacatacaaaaatgtactgcctgtggctaaagcagtgtttcaagtgaaactgacagctgcaaatgcctatgtacaaaaagaagacagatctcaaattaatagcctttctactttctactttaagaaactagaaaagaaaagcaagctaaactcaaagcaagcagaaagaaggaaatgataaaggttacagtggaaataaatgaaatagagaatcgaaaaactatagaaaatcaatgaaacaaatagttgatccttagaaatgatcaacaaacttgataaaccttatctacactgatcaagaaaaaaggagagaagatttcagttactatatgaggagttaaagcgcgaacatcactaccaatcttaagagaaattaaaaggattgtaagggaatagtatgaacaactcacccactgctggtggaaatgtaaaatggtacagccactttggagaacagtcacccatatgacccagtattccagactctagaaaaatgaaaacatatatgtccacacataactgtacatgaatgttcatagcagcattattcataatagccaaacagtggcaacaacccaaatgtccaccagtggatgaatggctgaacaaaatgtggtctatacacaaaatggagtatcgtaagaaggaatgaagtcctcatatatggatgaaccttgaaaacattatgctaagtgaaagaagccagtcacaaaagaccgcatattgtatgattccattgatatgaacgtgcggaataagcaaatccctagagatagaaagtagattagtgtttgcctaaagctgaaggtgggaatggaaagtgatttttggtgggcgtgaagtttctttttggggtgatagaaatgttctaaaattacactgctgtcatggctgtacaatcctgcagatacataaatccatttaattgtacacttgaaatgggtaaattttatggtatgtaaattatatctcaataaagctattaaaaaatacaacacaaattggggttaaaatgctatgtctgtctgtctgcctctttctcttttatgtcccctaccactaacctccttcccacagctgagggacaagatgtgtcattccatttattcaagtctttaaaattatatatttctcagcaaagctttatatttttctttattcaatcagttgcctaggagatagtaggtctgagggatcaaaaagacactgttttgctaagggtgacccaaatattagataatcgatttgagaagggtagagaactggctgtggcatcctattgttcatttcttgagaaaaaaatgagattctctgtaaatcaaaagccaaacctcttatattctaaattctgtgcttcgtagaaagagcctctgctagaaaggaaagaatccatttatgtttccagtttttcttgccgttgtcagtaactgcgttggctatttttgctcataaatctttatccacagctctgatgatttctttaggaaagatttctcagatgtggaattactggacaaaagtgtgtgtatattttatggtacttggattcattatcaaattgacttcctgaaagcttgcactgatctgtctcactactgaagtggggagagtgctgcttagtgttctaagcttgaatttctcagattaatcgagtgcttgaacattttttcttccgtcatttgttaataatctttgcactttatattgaggtccttatttttttttttactggttggtgtactattcctttgtcattcatggcaaattttgcttcccaatttgtttgcttttcattttgtttacgattgattttgatgcacagaaatagtaaatttttatgtagattggtatattgatgctttcttttgtgatttctctgaataaattatcacctagcttatctcctttttttatactggcttcattttttacttcaaaattttaatctgtatagaattttgatgtgtagtatgaggttagtatacaaattgatttttattttgaaatagccacttttccaggaccatttattgaatagccctttccagtgattgtatgatacctcatttatcatataatattattatatatatgaaagtctttgggctttcaattctataccattaatttgttttaccattcttaatatggttaactattatggctttataatatattttaatatattgtatggcaagctttcagccttcctatcacccttcattttcaaaaaggatttagttactctcatttattttaaaatcatgtcatcaagttaaaattttaatttcattcaaattataagtcacttttagaagaattaacatttttctaacatttttgtttaaagctttgcattgttgcataaaccaactttatatacaagtatataagtgaaaaccttttctcccccacctctcctccccaaacatcacagtaggctaattcttgtaaattaaaacatctatccccttctgaattctaaacagcttattctagtcagccagtgacatgggatgtcactctgttgagtcaagtgttacagttttatttgtgcagtcttgcttgttgatgacgttattcccagatagatagtggttattgttggcttttgtaaataggatctttcccctcatattttttgtattgctggtacgtagaggaatttaacttttgaagatttctttacaatagcccttgtggaacactcttgctaattaaaaaaagttcctcttttatatttagaaaattattagtacctatcagtcactagttttcagaaggtggataagtggaaattataaaatgctgtatttgaacaaatgatattttagaaacaaaaattccttggcttggatagaacgctgtgtgtgtgtgtgtgtgtgtgtgtgtgtgtgtgtgtgtgtagggatttttatccaaattaaggaattttatatatacagttgacccttgaacaacacagctttgaactgcacaggtccacttatatgtagatttttttcagccaaatgcagatagataatacagcatttgtgggatgccaaacctgtgtatacagagggccgatttttcccgtgcttgagttccacagagccaattgcgagacttaaggatgtgtggattttgggatgcgctaagggtcctggaaccaatctgccgggaatactgagggatgattatatatgtatatatatgcagctgttaacagtgttatattgtatatttcaaaataaacagaagattttgaagttttcactacaaagaaatgataaatatttgaggcgatggataagctaaatacccttacatgatcattatacaatgtatacatggatcataacatcacactctaccccataaatatgtacaattattatgcgtcaattgaaaagaaaacttaaaaaagtggacatgtgcaaacctcaaaaaaaatcaaaagctaactttcattagttcatattatgaaaacaactgtttttgtttggtttttcaactatgacagtatattaaatgaaaaaaggaaaaccttagtcatctgatcttaatgatttgtaatctgatcttagtgatctgatcttaaatgaatttttttatatatttggggctgcatttcattctattaatgcatttttattcttccgcaagtgttgtgcatgtttaggtttttattttctttactagattataaggcgcttgaaggaaagaaaccacatcttattcatcttggagctcactttaattgttgaatgaagtatatgcttgtactcatataccctaatccttttgaaaaacaagttacttcaaggcaaactaccagagggagaactaacttattaagttacatggttaaggggaagctgttgaaattctgtgattcagagaaattgtctttggtttctgagtaccgagggagagaggagacttattaaacatctgttttaagagtggatcctagaataagtactaaacctaggtcttggcctgaccacaggcagtttactagagagagagaaggtgaaatagtttcagaggaggaaattgcaactagatcttgagtaatgagattgaaggtggagctaagttagaagggtaacactgtgctcaaagagaagggtcctaaaattttcacattcacttgtgtaacatgcgatggcgagtgcgagaatgtatacaagacaagggaaggtttcaatttcatgtgaacattttaatctatatttgattttacccttttgcccaaggttttataaatgaaagtgtaggccgggcgcagtggctcacgcctgtaatcccagcactttgggaggccgaggcgggcggattacctgaggtcaggagttcgagatcagcctgggcaacatggtgaaaccccgtctctactagaaatacaaaattagccgggcgtggtgacacatgcctgtaatcccagctactcgggaggctgaggcaggagaatcgcttgaacctgggaggcggagggtgcagtgagctgagattgcgccattgcactccagcctgggcaaccagagtaaatctccgtctcaccaaaaaaataaacaaataaataaaataaaataaaataaatgaaagtgtatagagttcagtttattttctatatagatgtgtactcttccctttttgttggagtacatgggccagacctagcttttccttcatttctgggcttttccttctctgatatttgattcctcatcactttcatcaggaccagggagggaaagttaattttggactatgtgattatgcatcagttttgcctgtcaggaacctagtattatgaatgattaatgattagtattgttctaagatttcaatttaggtaaaatttatctctctaaccacctgcagcttgcttgttgaagattctgtaacactagagcagggaggtgacaatccctgtgggggtggcctgagaagctcttttctcccctcccacccttagtctcttcttgcttctttttcctctctgcccccttcttttctccctagggcccacttggatggattctttggtattgtcattccttacaaaggaaaataaaaattcccagatagtttgccactgagttttccctttaattattttacccctttgctagcccacattatttgagagattaaagcaaacaaatgaacacagcgtgctgcttaatagttatttcttttatggaaatagagttctgctatgttgcccaggctggtcttaaactcctagcctctagtgattctcccaacttggctgctcaaagtgcttaatagttattttttttaaatattgtttagggaaaaaatgataccagttgttttatatttgaccttttttaaaaaaaagctttaaagcagctctttgataatatcactagaagtagtttatttctttttgaagaaattagcttcctttgtaatttacttttgactacatcattgagataaaaggtaaggcagttgaaactatgtacaaaaaggaaaaaaaaaatcgctcagttactgatgggtctggcactgtgtggttagggatgggaaaaccagcatacactagaaatgaaaatcctgtttctatttcatacgtatacatatactttaaaaactttacatgttccctcctaagctttggccctgtagctcttgcccttcttgcacagaactcatgtgcaattcacattaatgttgaagagactcctttcctccctccttctctcccttcttccttctttcctctgttcctttcttcctctgactctctctccatccttctcttccatactttctaaggaccatcccattctggagtgggcccttagggtgtgggtatatttaagtgtgtgtcattagctcttagttaccttttcacagagttgatgggaataaaatggaccattgaaatccaggaatgacccacagaaatgcttttgcagtttaactctaaacctttttattagaaaggcttatataggatgtgatttcacttttctcacttcctgctgatcctctcaggtggaggtgatcataaatttaaaaatgaccaaacctaggcagcaagaaggaagagaggtaagcatcagctggggattttgtaggatcagtctctctccttccacatgttcataaattatgaactgtatcgatccattcacattgatgtatgaactcattctgccaaaagcccaagttgaagtggaaaatggaaagtgatcatttattagagctgatgagtgtcagctttgtactgaaacaaagaaaacgaaaccacacaggcctggacggcctccccttcaaccctaagattctgtggccagaggcaagtgggcctgggggtaaccagcaagacttagtaacagtttacaaatatcctgcctgttttcagtggcttggaatcagactgttatctccttgaggctggaaaagcatttctgtgcctttatctccccatgacttctgcccaggatgattcagacaccctcactggaattatcttcatctgaataattctcagctctatcagccattatcaatgttgggaaggttatttcacctttttaagcatcgatttcttcatctgcaagttgaaaggttgagaagtttctagtatgtcttcagctgggcatggtttctaaaagcttttgttcctatcttcatcagaacataactagttctccagttcagggtcatggtactgtttatatagagtcctcaaagcattttaacctgtgagccctcatttggttattaagcttttggaaatgttgaaaagcttaagcatcccacttctctctttgcaaaccctccccaacgttcccaggaagaaatattggggtccagtctgtgtaccatcagcccattctagctcctacagctgacaaacatttgttgaacaaatcaagttcccacatgaccagtcagaagcctctggagagcttcaaagaattctttgctgagaatgccccatggtgattttgttgagtaatgaagttaaaataatgtttctgtctttggtaaaccacccattctcacctactgcatggcagcatgggtttctgccagtctttactcagcttgattgcacaaggttgggcaggtggtgagatgtgtattcactttgccttcagctcagcatgcttcagaatacaggtttagcatcccaaatgtgaaaatccaaaatctgaaatgctccaaaatctgaaactttttatgtgctgacgtgacgtttaaagaaaatgctcattggagcattttggatatcagattacagatactcaactggcaagtataatgcaaatattccaaaacatgaaaaaaaaatctgaaatccaagacacttctggtcccaagcttttctgatgagggatattcaacctgaactgcctcttccaaaggcttttgcatatcatctccatatttatttcagtgggtgtgggatagaatcacaaattctagctgccagttccttctcctcaacctgttagatgatagctaaagattgctagctaagtgatacttttttatttgagatggtgtctcgctctgtttccaggctggagtgcagtggtgtgatctcggctcactgcaaccgggttcaagtgattctcctgcttcagcctcctgagtagctgggacttacagtcacgttccaccgcgcccagcacgtttttgtatttttagtagatactgggtttcaccatgttggccaagatagtctcaatctcttgaccttgtgatctgcctgcctcggcctcccaaaatgctgggattacaggcatgagccaccacgcccggcctaagtgatattttttaaagcatgtttaatatttcaaaatgaggttttaacagagacacatagaaagggatcaacaagggacttgaacaaatatttgcacacccacattcagagcagcattattcgcaataggcaaaaggtggaagcaacccaagtgttcattgaggatgaattgataaacaaatattatccagccttaaaaaggaaagaaattatgacacatgctgtaacatggatgaactttgaggacattatgctaagtgaaataaaccagacacaaacagacaaatactatatgattccacttatgtgaggtacctagagtagtcaaatgtatagagacagaaagtaggatggtggtttgcaggggctgagggagggataatgggcagttattgtttcataggtatataatttcagttttgcaaaatgaaaagacttctggagatggatgttggcgatagttgcacaacaatgtgagtgtacttaatgccactgaactgtacacttaaaatggttaagatggtaaattttatgttatgaatgctttaccacaataaaaaaggatcaagaataacatgacaaatacccaacacccttctacccactaccagctaagaaattctatcaattagcaattacagttgatctgtcatgtatgttaccttgtctcagttgcattgtgtgtgtttcttgagaagcgtgatggatgacttgggtaagagaattctgggtcaagagagcattccttctcctgttttcttttcatttttatttgttagttaaagataaacatagtacaataagtaaaaaattaataacctttctctgtcctttaaaattagtgttcctaactctaaaaagcaatgtttctagaaacttctgtttaccctttgggctctgatgaatgtggagaaaagagagagaacacttaactcaccaggatggaagaataagataaaatatttgcaacctccttcctccctgaatgttgtgttaaacgtttttttgaggacttgcgctgtgtcaagtgttgtcgtatcagttatctattgctacaatattgctgcataacaaattactacaaaaccccagcagcatacaacattaagctgctctgtgtatcttgcttgcattatgtgtacaacaaacccctatgacatgagtttacctatataacctgcacaatgtacccctgaacctaaaataaaagttaaaaaaaaaaagaattaggaccttaatgcaatcagtacgccctagttacctatgcaaatgttgtagtggagacatctatgcagtcctttaaacaaccctgagaagtaggtggcattggcctcattttgcagttggaaaaagcaaggctcagagaggttataagacctatccaaggccacactgttagtgagtggtgtagtttgggtttgaacctgggtctgtcagacgccttcctccatgccgcctctgccaaactccatgcagcaccttggattaccacctatggaaacattctgttttgccttttgtgcttctatttgcccctcccactcccgctctactcctttctctattatatttgattgagtcctcttctccaacttctgaagtgtaagctgtttctatagtcctgtctttggcatcttcctgggttcagctaatgccatgaagcatacgattccctaagcccaacctctaggctggccctccctccttgctgccttcatgtccactctcagacactctgtgctggctactggtttctgggctgcaagtcataggcaacgtggttccatctggcgtaggtcatgaggaaatacctgtcttgtgtaacaggaagttgtacacacacagggcaggcttgtcagggcccaggtttcttttctgtgccctgcctctcctggagttggctttgtgctgtgaccagcaagtggagcaacagtggacttcccagtttacatccagtggggaagtgcaggggacctctcttcatttagatgctctgggcagacccacctttgtctctcactgtaccaccctgacctaggactgcctgcccatccctgaacctatttctggtgggagctgacccacgtctggtggtctgtggtggagtggcagatgggagacagtcactgtgtccccaactgtccctatgtggttgagcagcagattctctctcctgtcagactcctgttgcttctgtattctgcattttatttgtttttatttatttttttgagacagggtctcactctgtcactgaggttggagtgcagtagcggaatcatggctcactgcagcctccacctccagggctcaagcaatccttctacctcagcctacccgagtagctgggactacaggtgtgtgccaccatacctggctaatttatctattttttttttttttttttttagagtagagacagggtcttgctatgttgcccaggctgggttcaaactcctggtctcaagcaatctgcctgcctcaacctcccaaagtgctgggattacaggtgtaagccaccgtgctcagctgtgttctgcattttagttggtggcattaccaaccttcacttcctcccatcgacactttggggtcatttttaattcttctttcttcttcatccccttatttacttacatgttttgttctaactttgtttatgagatggttgttaaaggtctgttctgggctagcctgtagtaatccccaaggaggccagctgagttcctgttcacagagtctaggatttgagaatcaaacaatccccaggcagcgtgggcagggtaaagagaacattatacactgggtgctgtgctctctcatggttgttattggtggtggtggttgcaggggaccataaccctgcctcaaaagcagtcagggaaggtgtctgggagggggtcacatgtaagctgatgattcaaccttagccatgtctcttgttcttcctttttaaaaaaatattccctggtttctgatttggactcttaacacttcttcctataaaccagaagtcagcaaacgatggcccatgggccaaacctggcactggctgtttttgtaagtcaagttttattggcacacaggcacacccattcatttatgtgtggtctatggttgttttcaccactacaatggcagagttgagtagttgctacagaggccatatggctcacaaagcctgaaacattgactctctggccctttacagtaatagtttgctgatctctgcggcagaccattagaaaaaccgaattcctgcctgccgggaagtttcgtcttgcaaaaagagatatacgtaatatatagaaaattttataataaagccctttgaggtaaagacaattaagtgctgaatacaatatttaaatgctgacaaaaattattgttggggagattaatgtggatttatttttccctactttctctatttttctctgctctttctctattctgcaaatgaatcttcattcattttttttcgcctcaggatttttagactgacactttctagatttataacttctaagtttacacttttcatgacactcactttctgccctctgagagggggaggaaaggtatggatcagtttggaaaatgaagtctgggtgagatataaccccctcttttaaaaaaatacacctttgcacctttcctgtatttacaaggaaagtgggatttgtttaaataaagagaaaagtctttatctgcttcgaataaatagataggacgtgcattactaacctgtttgtttggtggggtcggcgggggacatctgcttaataatctgcccttttctggatgatgcttattccccaccccaccaagaggggactgatttgttgtttttctgatccccacacaatcatctgctcagtagggcagcttttgtgctattgggttgtttacacctctctgctcttttaaaacattttctagtttgaccttttcttttagactcatcctaacttttcttagacttactataaaaataatacatgtttagtgtaaaaaattaacagagtcaagtcatggtgtaaagagtcacatcaaatcccttccctgagtcatacttcctggaagagacttggttcatggtcatccctacagatctctgtgtagatattaggaggaaccataagcagatgcagatagtcatttgatcataaagatgtcaatttcaaacacatagtggtacatacatcttggcattttttaaaaacacagatgggatcatactgttcaggctatattgcaatttttgtattaagttgacgagaatcttggaaatcttgccgtatcagttcatttagagctatgcttctctttgctagtttgtgtggagatacacctatggcttaattaaccagttccctgattgaaggacgtttaggataattctggtttttcactattctgactaatgtagcagtggacattatgcatatatctttgtacatttcatgtgagttatctggagtataacttcctgaaagtggaattggtgttttcttgactcttttacttttaacacttttttttttttttttttttttgagacggagtctcattctgtcactcaggctgaagtgcagtggcgtgatcttggctcactgcagcctcaacttcccaagctcaggtaatccacctcagcctcccaggtaactgggattacaggcgtgtgtcactacgcctggctaattttgttttgttttgttttgttttttgtggagatggggttttgccatgttgcccaggctagtctcgaactcctgagctcaagagatctgcctgccttggcctcccaaagtgctgggattacaggcatgagccagcatgcctggttgagacattttttttagacttcttttttttttttgaagaactggtcagatgcctctggtcccagctggccatgctgaccatagggtccttcatcctctagtgataccacagaaatggacctcagtggaagtcaggcaatccctccaggcagatcctgtgcaattataaacattagcatcaacttccctccttctatggaatatttctgtgcttgcagcccggcaggcactggggacggacacacacacacacacacacacacacacacacacacacacacacaccagtgcgcacgcgcacacacacacacacacacacacaccagtgcagctgagtagggctgggagcaaggggtgtgtatgaagccgtgtgggtacatggaagccctagtgacctctttatacccgaaggatagggggaaacttgtagtgctttccagaatttaagtagtcagaaaagggagagaaaagtagggctgagttgggggagggtaatgaggctgtggcaggtgtcagcctgcaaattagctgtgctggcctccctggaagaaatcatgggcattgagctcagccaagccagggcaccagatgacagagtggggctctcgccagccactgacccaagtaataagagggcacttggcaagcagcttcatgagcaccgtgccacgtggccatttgtggttcaggacttgcgaagttgcccaaagtggctcttttgttatgatgtgttactccaaagcttatgaagcattccaatgaacagagtccaaatgttatgtttactgctttgttaaatataaatagtttacccttgtacctttgggtttccttggaaactgtaatttttttaaagataggttcttgctctgttgcccaggctggagtgcagtggtgcagtcatggctcactgcaacctagaactcatgggctcaagtggtcctcccatctcagcttcccgggtagctgagactacaggcacacatcaccatgctctgttaaatttttttatttttattttttgtagagacaggttctcgccacgttgctcaggccttgaaattctgccctcaagggatccttccaccttgacctcccatagtgctggaattataggtgtgagccgctgcacccagcctggaaattacaatcttgaaagcagggattgggggttctttttatttaaaaaatttccatggaacctgtttgccagtctggtgaagcctgtggaccccttttcagaataatgttggtaaatgaataaaaagggaaccaaagaattacaaaggaaaccaattatgttaaaatagttgtcaaaatagtacaaaaatacaagcaagacatatgctttattatagcaacatccagcagtgggtcaggaggtgatcataattttgaagcaggggtgagtgtaaatgatagttcaagataactgcaactgtgaaatgaaatgaaaatatctattcatgtagtgggaaataaataaatttcatagatgctgctagtaccattgtggtttgttgcttagattcacggtgagaataaaggccaaatttcagaagatagtaaaagatgtatttttcttcccatgtaagtttagaccccctgaattctatccacacaccccagttaaggacctctgcttaaggggtttagcctttcagattatgaggaatgaattgcagggatataaactcccatttgcatcaagaaaattcagaaatacctaggcttcctcccctctttattctgatggggatgagaagggaaactatattaaaaatgagtcaaaatttaaaaatattatgactacctgcaatgaagatctccccctacccccaaaagagagggtacatgtggaattctttgacactttctaaatctccgagcacagtggccatttttggtactgattttaaaaactgggaaaccctagatttgtttatggtgtgtatctcccacccccacaacccacacacacatacctcccagtaattctctaagattaggcaagacagaagtatcccagatgaaggtctttaggattttctagacctttgttacagttcttcaaatgtttgtgtctttttttctcctctcctacccctcattccctcatcttttccccctccctgcccattctacctttaactgtaaaagttaggtgtctgatatattcatttgtcagcagcaaagtttgagaatgcctttaaaaatagatatgttagagggagtatgttggatagaaaggagaaatcttgtttatgctcaataaataacttacatttagaaccttccttcaatttttcctttgaaattctgtattctcatttcacttgaatgactctgcatggagcgtttaaaagtagatcaaacaaaaccctataaatatgttgagttcttttgggcattttgccaaaattagccttgcagggaaaagcagtgtgctttacgtattggattttctcctctgaaaatccagactccctctcctctggagagctagctgccagggctgggggaaagtcaagccagggacacattagggaagtgtccctggtatggcctgctgaggttgggttatttggattgagggttgtgctgaaaggccaaaaccaatgcctgggaccagcctgaagaaagatgaaaagcagagggacgtttagagacgtcactgattttatgttatgacgtgattcctttatctcactctgattggaagggaaggctggtgaaaaaaacattaacagagctgtcttttaacagattcctgaatgtaaagccaaatggaaaaaagggagagagtcaggtggaagtaagccccttggaaagtaggtctgtctccatcatcccaattttatacgtgagaaaaccgaggcagagagccacgcaggggttgcaatgctgggtgagttgggccgtttgtctcttctgtattgttaactcagggttctctattattattattattattgttattattattattattattattattattagttagaggtggggtctcactatgttgcccaagctggtcttgaactcctgggctcaagtgatcctcctgcctcagcctcccaaagtgctaggattacaggtgtgagccaccatgcctggccccagggttctcttttatgtgctttaatgctttaagtgaagaccacgtatccatgagcagtgaaatcagagcccctgcaccctttcacatggctaattcacatatcatttttataagatatagttgaggtggaggatgttgagttcttcatgctcatggcaccaaaattacagatgtggcttctaaagaaatatcagatgacaatgttaatgttaaaatatacatatacagctcctctttgcagaaactcagtttattcaatggatggcccctttgactattacgttggaagtagaaacttgatttgggggggtcagatgttaattgcccaaatttaagacagttttcagtgacttctttaaatgaggcattagactctgaagttcatagggctgaggagggcctggatcggggattttctagatatatggcacctggggtccacatagggatctagagtggtgcagtggcatcgccctaaccatcatgaggcagatgtgagtgagtcgaattggttgatacagatgtgcgtgaaagagctgagaggtgtcagggttgaaaagatggagacagacagcaaccgacactcacagataacaaaaacacaatggaaggaggacagtgctagagaaaagcaatggttgttaggagaacccagagaaggggcccccacggctgaatgaatgagtatgtatgtgtgtgtgtatgtatgtgttcccatgagtgaggggcgagctcggaagatggacaccacagggcccctccacctagtgagagatggctgtctgggctgtgtaggctggtggtgtctggccagggaagataaccttggcttggtcactgatggaatagtatgggcctcctcagggttctgtaacagcatctgatcagaataatgactaatgtgggctacagatgtggagccctgtctctgagctcacacctcctgctgtgttcgtagaccagccacaaccagttgtcattgggaggtccgaggccccttgtcattcagccccatgaaaagcacctttcttgctgattgaattgatatttatttctttcaaaacaccaactcactttaccattaatgtaatcaaagtgtgatcagaaaggtaagtttcataatgcaaggtaattattttaataggtgactgtgatgtttttaaaaagtgattacagtatattacgtgctctttgtgaagacaaattgatattgtagaagcatttaaatgagtttctacccttcccccaatctgcctcccctgaagtatcactgttactttggggtatagccttccataccattttctgtgcttacacaagtgtgtccgtgtacatataccccctttctctcattcatttgtatctttttttgagacagtctcttactctgttgccctcattcatttaattgtattagaccttcataaattagttgaatgttgaatggattcatttatttattaatgaacatttgttgaatgtatactctgtgctaggttccgagttatcaggagtaactaaaatgctacatgctgcttagagttatgagtgtgtgtgtgtgtgtgtgtgtgtgtgtgtgtgtgtgtgtatttataaaattgggatcatagtatacatattacgtgatttagtcttttagtgtactatggacaccttttcacactgatacacgtagagctacttgttatatttaatggctgctggatataccttcccctcccagtagacatccaggtttcacatgtagatctctgtgcatatatgcatttgctattagaaacaatgctgccctgaaccttcttatacatatatctttgcctacttaaaccaaatgttttctgtcttttaaggggaccgaatataaaatcaaacatacgtcatttcttgttcatatatagccctgctctacggtttagtaaagttaattcacagggggccatacgtttgtaagaggaaagcagttagaggcatagattagcattatttagtattacagatgcttcagactacaaagttgatggagaatgagttggtcaattaattgaccaacttcgacacaccaacaagactgcagggtctaccatctttccatccctatagcatcaacaattccagatggcattgacttttgtttgtttggtatatatatatttttgttttgagacagagtctcactccgttgcccaggctgaagtgcagtggcacaatcatggctcactgcagccttgacctcctgggctcaagcagtcttcctgcctcaacctttcaagtaactggcactgcaggtgtgtgccaccatgcctggctaattttttaattttgtgtagagactgggtcttgctgccctgtttaataccatgttgaagctttaactccctttccctccacctttcaggatgtggaattcattagttcattcatttgtcgagaatggattgagtgtctactcaaacagacactgagctaggtgcaggtatgaaggacaagtaagagaaggtcattggcccccaaaggaggcaacaggcatgtcagctgacaattgtttggcgtatgtctgtgtccatgtctgctttgtggcctctccttctctgggtgtgtaattctttccactgtgtttttccagctgtgtctttcattcttctgctgggccatctcctgcttctgggacccctccccattgccattctgcatatccctgacaccgagcccttctccctggatccctgtcctcatcacatcttgttctacgcttctctatccagaagcctcctctggtttcttattgcccacaaaataaagtcctcatctttagcttggcatccagagtccactagaaactcactcccaatctgccttcctggtatcatcttgcgttggtggaagaagagggctgaagaccacaacttatttaacccatgtaccctggacaagttattgaggcttcctgtgctcatcataaagatggggccagcatgctgaacctcctagagttggcctcaggacatgagggaaggccagttacatgccaagcgtggttcctggcatgtagcaggcactcaatgttcatttctttcttttccaagatgaaggtgatttttcttctgtgacttttgatgttatctgcctcccttcctaccctccatggctcaaaggctctaataaatggttccctactagttctacattttctcttatatcctgccaagacttgggagaaaatgagcactggcatagctatacccacttgtcagatgccctctgcctttgaagtagcaggcaaatggatttcctgtgttctgcggtgcagagatgttgattatacacatccctgtgaaaatcaagcaggctcatctccagggaccacacaatgctggttaattaaatattatacatttccactgcaacagtccaggtacagccaagaggggtttgtaaagaaacacccacagggtccttttatttggagtgccattggcttctgaagtgtcctcctcttcctgtgagttgcattatgttgaaacaggatgacgagtggaaatgtttccagtaaagagtatgatgcaggggttctgcaagatcggtaaatctaccttctcttcccttgtactcggaatctactggacgtcccaagtaaaaaatgtgtgaatctatacatttagttaagtttgtattgttttctccatcctgagatagaaaacatggcttcttgcataaattgaagtttccaactcaagaacagcctttaaagaagctggcatgctgctcagtaactggggagttgctgccttccccccaccccctgagcccctggcacctagcagtgtttgttaatgaatcatagcagagacgtccatcttctccactctcctgccccaacccaggaacacatttccagagctagaaactacttactgcaactgttccaaaggtctgtgaaataaacatcacagcacagcagcattcacctgtgctatgtattaaatactattgtcagatatttagaagtctgagttctctcccttgtgggaaaagacaccgaatgtaggacctaaaataacctgatcctggaagagtcccattcgtttttggcctgatgctcttctttgggcaacagatctgactaggtgtctctggaccttggctgcacattagaatcacatggggatcttttaaaatccagatgcccaggctgcacctcagaccaatattgacatttgaatctctagaggtgggtccaggcattggtatttccccttaaaatttttaatcagaaaatattttaatgcacagaaaatttgaaacaatagtacagtgaacacccacctagatttaccaattattagcattttgtcacatttgctttctatctctatcctctatccaatctccacacatactctttttgattactttttttaatcattgggatttttggcgttttttttttttttttggagacaaggtctcactctgtcgcccaggctggagtgcagtggtgtgatcacagctcactgcagacttgacctccccaagctcggacaatcctcccaccttggcctctgtactagctgggaccacaagcacatgctgccatgccaagctaatttttcattttttatagagacgaagttttgccatgttgcccaggctggtcttgaactcctgggctcaagtgatcttcctgccttggcctcccaaagtgctgggattacaggtgtgagtcactgagcctggcctgatttttttccttaaacggtttgaaaataaattacaaacatcaggacacttcatccctaaatacttcagaatgtatctcctaagtatgaggacattctgctaggtaactgcgatagaattaacaactccggaaatgtaacattaacatgctattatctagaattagttcatattcaaatttccccagttttctcaatgtttttatagccttttaaaaatgcagaattcaattagagatcatacattatatttagttgtcatatgtctttactctttttaaatctagaataattctctagccttttaaatatcttttgtgatattgacttaagaaaaaaatatttctgtgcctagcttatttcacttaacataatgacctccagttccatccatgttgctgccaaagacaggatctcgttcttttttatggctgagtagtagtctattaggtatctataccacattttattttcttttttttaaataaattttatttttaatttttgtaggtacataggtgtatatatttatgggatacatgagatattttgatacgggaatgcagtgtgtaataatcacatcatggagaatggggtatccatcccctcaagcatttatcctttgtgttactaacaatccaattatagtcttttagtaatttgaaaatgtatgattaagttgttattgactatatcatcctgttgtgctatcaaatagtaggtcttattcattctttctaactatgttttttgtacccattaaccatccccatctcacccccgacctgctcccactacccttcctagcctctgataaccatccttctattctctatgtccattgggttcaattgtttggagttttagatcttacaaagtgagaacgtgcgatgtttgtctttcggtgcctggcttatttcacttaacataatgatctccagttccatccatgttgttgcagatgacaggatctcattctttctatggctgagtagcattccattgggtatatgtaccacagtttccttatccacttttctgttgatggacacttaagttgattgcatatctttgctactgtgaatagtgctgaggtaaacatgaagagctaaaaaggttgatctcgtggaggtagagagtagagaggttggttactggatacaaacatacagttagattgaaagaataagttctagtattcagtagcagagtagggtgactatagttgacaacaatgtgtcgtatatttcaaaatagctagaaaagaggaattgaaatgctccaaatacacagaaatgataaatgctcaaggtgatggacactcaaataccctgccttgttcactacacattctatgcatggaacaaaatatcacatgtaccccctaaaaatgtacaactattatatatgaataagaattttttttttttggctaggtgtgatgactcactcttgtaatcccagcactttgggaggctgaggcaggaggatcacttgagcccaggagttcgagaccagcctaagcaacatagcgagaccccatctttacaaaaaatacaaaaattagccagtgtggtagctcacatcggtagtcccagctacccaggaggctgaggtgggaggatcacttgagcctgggaggtcaaggctgcagtgagccaagatcacaccactgtactccagcctgggcaacagagtgagaccctgtctcaaaaaaaaaaagtttttaagaaaaaaatcagatgagttttttgtttgtttgttttgttttttttgagacagagtctcgctctgttatccagattggagtgcagtgggacaatcttggctcactgcagtctcctgggttcaagtgtttctcctgcctcagcctcccgagtagctgagactacaggagtgcgccaccatgcctggctaatttttgtatttttagtagagacagggtttcaccacattggccagatggtctcaaactcctggcctcaggtgatcctcctgcctcagcctcccaaagtgctgggattacaggcttgagcgaccatgcctgaccagatcagtttttgtaaacggctcctcattttaaatttgcatgattgtttcctcgtggttggatttaggtaaatgttgtggcagaagtattctataggtgatgttatagaagtattctataggtgacgatattctataggtccttctcagtgcagcctatcaggaggcacgtgatgtcaatttgtcctatgattagcaatgttaacttggatcacttgggtaaggctgtatctgccagctctcttcattccaaggggaccattttccttttgtaactgtggggagatactttgagatttggtaaatatcttaatccccaacaagctttcgcccagtggttttagcaaccgttgattcttcccagaatcaattattactatgatggttataaaatggctattgtctggatatttctatcatttctgtatttgtcaatgttcttttgttaaaaaaaagagaaaaaaggagctttcacttctcaccccataactatctatctgatcttctttagctagctgtctagctacctgttaaacatattaatatggactcatgaattttttaatgaatgtattgtaataaattccctcagtacataccgtattgtcccaactttggtcagtggaagccctgtctagctgactcctgtgtccttttgaaattatcccttaaatgtttgagtacttcatgaattttagcacaaccagatattttagtctcactttgtatcttctttgccgtaggcttagaagaagccatttttctatggagacctagttcctctggagctgctatttaggaaggcatcagtagttttgtgaaagctccctagtcgatttcaatatgcagcaaagaataagagacatagattagagtcttccaaggggagaccacctgttcccacaaggtgtttcttttcttttaatcacctgttatttgtggtgctgatttgttgctgagatttagattttcatgtgtgttactcaagagatagctttaaatgcaggtccctggccccaaccccaaagagtgagttcagtagttctgccttgcattttaacagtctggtgcaggtggtccccaggccatacctgtagaaaatgccagaagtaaccctggaaactgggaattaggggtttcttttgattttcctcttttgctttttatcagtggtttctaccttgcaatatgatttcagaatactgccacgttccccaggtatgtggtaaggatctaattgattaatttgatggattctttgaaaatatcagatgatttaaacccttgtagctttactcttgttccatcatggggaattggggatgtgaaaaaaagaggtggtggggtgggggtggggtgggaagctttataagtgttggaagttttcagttgacccaaagacttttttcatccaatacattatttgttgttattagtttattttcacggacactgaatgaattggcctagtaaagttttcacatgctgtaagatcctaggatgtaggctctaaaatatagttgtgtgtgctgttttggggactgggtcatgacaccgtagtcagtttctgctatttccttttctgagaaggcaattaattgcattgcctccccatccaaccagctttattttattaaatctggggcctgtagggcccaagtgcccagcagctgtaaggaaaagctcctgatttgtggtttttcccttcctggttccacctttcaaacaaataccatgttagtgcagctagtcccttctgtgatctcaagacccaggactgagaatgcttaagaacagtcagatgtgggagggagatagtgcttctggagttgcgttgcctggtttgaaatcctctggtaaaatacatgatctctatgtgcctccgaggtcttcttgtctgtaaaaagggggttagtaatctaccccagaggttcagtgtgaggattaaatggggtggcatatgtaaagtgcttagcagtctatggcacatagtaggtgctcaataaatgttactattttattaaacagtaaatggtcacaaatggaagggggccgtggggtctagtgagagagttgagggtgtgctgtctcagttatcattagatcggctattgtggtatcatagtgcttgtgatcaacgaacccttatttcacttaatacagttgttcccccttacccgtgggtgctacatttcaagacccctagtggatgcctgaaaccatgaatagtgccaagtcctatatatactatgtctttccctatacgtacatatctatgagaaagattaatttataaattaagcgcaggaagagattaacaccaataaataataataaaacactaataataaaatacaacactaacaatatactataataaaagttatgggaatgtgttctctttctctttctcaaaatatcttattgtactgtacttagccttcttatgatggtgtgagatgataaaatgcctacatgatgtaatgcagcgaggtgaatgatgtgggcattgtgacgtagcgtttggctactattgaccttctgatgatctatgagaatgaggatcatctgttttgagtgatcctggatcgtggagtcacaacgctgtctgtggttagatgtgaggagcagacagtgtcagtgactcaggggcagggaacatccgtagcgtggagacgctggacaaatggatgattcacatcccggacaggatggagcaggatggcatgaggtttcatcacactactgagaatgacatgcaattgaaaagttatgaattgtttatttctggaatattccatttaatatttttggaccttaggtggccacaggtaactgaaactgcagaaagtggaactgttgataaggggggactactgtaaaaattccactcccagttcatttggacatgaaggtggtggctcaaactaaggaattccaaacctcaggcataggcaagtcataagtttttttcctttagtttatgtgagctattgaaatgaggtggcattgtcatctccttacctctttaaggaaggtcaagactcactagtaaacaccagtgaaattccaggagaggaaaaaaatgacaaatgactttcttagacttccttaagtttaagatggatggatgcaactgaaatacaatttctcccaacttcaagcatcccccttgaactgggttgtaggtcaggtggtactggcaaacaaattcaaatcagtgacaggctatagttgaggcctcgaaaagcagcattccaggagtttggtgttctctgtaatgagaggtccatggcagagacctaagtgacgtggtacagtgttgcaggaagaagttgagtacagattgcagagagtttggcacaaaatgtgaattgaattagtttatccagcactagagagagaactatgaacttaggctaaggaaatgctgccacttactagcttggtgacctggggtaagtcattgagtcctggattcctcatttgcaaaatgattgcccattctggcttttattttttaactcatgtggttggcaggaggagagggtgatggatatcagaagggtttgtgagctatcccagtgcgagggcgaatgattgtgcttggcatcaggtcacgtgatctttaccaccagccacctctgggtccctcccctgtgccctctgtagggcttactctttggcatgttggcagtgagctttgtaggactttatgctaccaaaacagtaacagtcatgaggctggactagcctggcagagagaaagtagcgaagacatcattcttctgacaccaggcaggcctttatggaagtccgatgcggggatttggtttaagagcagtctcattattctgtttcaggtcctacatccattgggttagtcttttctctaagaatagatcactctctcctttgccatttgtgcagtgttggattagatgctactttttacagagggttttttgaacatatgaacttacatacaactgtaagttttatggcttcagctaacactagatcttcagatggtgttattttaagtcactttggtcaggactttgacttctgtggttgtgagtgttggttttcagacgtttgtcatttcacttgtttcatgttcagatttgtgtctgcagagtttgcttttaacataacatccagcaaatgaaagccctttaaagattggtagtagaacttcattttaagaagcatctatggggccagtggagtcgcaggggtcaggagtgggatgccaagattgccttgtaatctagactttctttgctagaatgagaaatccatatcctttatggtacagggtacttgatttgccttccattgtatgggaagccatggtatagtggtggcgttctttgcatcggaatacccattcctcctgactttcctccttggaaaagcaagttggagtgggccctctgtcctagggagagccaagccctccttggggttgcactactcagcctgctgacagtgccatcagcatctaggaattgccctggaaatgctgtgtttgttcctaagacccagaggcttgtaattttgcacaaaggggtggagagtatttgtggagtcaccaaagatgtgattagacaagatatcgattctgaacttctgccctcttccttctattcaactctgttcttgcttagtgaggtacaggcaagaaaaatggaacagagagaactaggctgccggcttttgaaacatattgatcagggcacacatccgatgtagcacagagaccttcccctttatatgatgtcatcctgcattggggccttaatgtgccctgtgatcacctctgcatggacttcctttctcagagaaaagattagagaagaaaaagaatccctgtaggcagtgctaaaaaataatttaagcatttctaaatgtgtttctttgaagtcattgatccctttggttttctaggccatgcagtggcatgaaggaatggtgtgaggcggtcagccatgaacgacaaacttctgagcaatgtcggtctcacttcctacctcccatccacctccctggcttgggcctccactgctgtctgtctgtctgtctgtctgtctgtctgtctgtctgtctcaccctcacccccatacacgttctttctccacatagtgcacatctgtggtgtggatatgctgtggacagttgtgtctgtacttgaaccagctctaagccagggtctcccagataggacatgctgggtgagtgagatgttgtaaccctgagtgtcctctggttgagtgaagtgtggccctggctcttatcttgatttgtctggcttggttctgcgtaagtagctggggatcctgttaatggatcccctgggacagagggaagaggacagaagtagatttgttgaatcctgtgggggtgtttgaaatggtaccaagagcaggctgaaatctaatcagccttcacttatcaggcttgagttcccgtatgttgaaagggtgacgattagtaagaaaaaggccaggatactttatctttcctttgcacatttagaaaaatcccctctgccttgctagcattagaagcagaccattcttttttctctaccacatcacatcagcttccattaaaaatcaacagcagcaaatacaaagccccatctatggaaaaccgtttaaggcaacactgtgctccagtgcttcaggggtggggtatttgccttctgcaccaatggatcggtttctcatatccatgcctttctgacccagcagcttttaaaagaccaagaagcattgctctgctttctactgcctctctctaagagaccagggctgccgtgcctcaagccatgtcccagagagcatatttgagacaagtcagcttaatttgcctgcatgcctaggaagcctctctttaaaatctgatttggggagaagagctgtctctaaatattttgcttttcccatccaggcgagcgacggaggcgccggtgccaggtggcattcagctacctgccccagaatgacgatgaacttgagctgaaagttggcgacatcatagaggtggtaggagaggtaagcgacctggccgggcagtgcaatggcctcgaatgggctgtcatagtcactgcttacccacccatgaagacgccttgctacagactcacaggctgtttggccttgaagttagggatcctctagttgagtctcctgtctgagaaaatggctttccccagaggaatgcccccaagccagctgagttcatacctggggccattggaaagcattgtctctaacacagcttactaaatacctccgaatttccaacgcagtgccaccaagtttctcttctacttgaattgagcatagactctgggcatccagagtgacccagatccatctttagagcatggatttagtattcattgtgggggacgctgtggatttagagggcaaaaaaaggagtgacatttcttagaagacctagtatgtggcagatgtgacaagattctttaagcattagcccatttcctcagcccacacggtttattgtgcgggatgaggaaggaggatcaagagaccctagaagacgcagggctgatggccaagcctggtccctgtgactggagaccctcactcttcctgctgtaccacattctcttattcctgctagtgaaatgtccctccagattccctcaggcctaggggatcctgggtttcaggcttagaaccttatcattcattctgattcaacagttgtatctatatctagaaacacagttttccatttgcttattgcttgctgataccctctgaccttacagaaacccacaattcatagaaaaggaagctagaagttgaggatgactttaagggagctgtcatgtgagtggaagtggcaggggtgatgctagaagccagatttcctagctctcatacataacctaatgtgaacatgtgtcagagttttatttaactcattaatgaagggatctgtaagatggtaaggctggcctgaagagaattgtgaaagagcaaagataatgactgaaaaaatttaagattgctaagttacatgcaaaactacatagtgccctacagtgcaataaaactgtaacctttgaggttatcttttctaggggacaaatcctttgcatttctgctcgtcaaaatttatttttgttactacctggcaagaatcatttgcagtgctctcagttttcaccagttgacatccacagtaacagagttgtaaactagcctcataaatagtacatagtgtgccaagcagagatacatgtccctccagaagcaattaatggggtccccagtgtggcactgggagggcatgcaggaaccccttttacctacttccgaattttggataattaacatgtcattcatccttttttacccctggtggcaagcagggcacataggagacatttattgaaagttgaatgagtgaaaaaatgaatggacaacagagaacatttatttcggtggtagaatgacaaatttcttaaggctgtaaccatggaaagaaattccagaagaaaaaataaacagatgtgactaataagaaaaatggttaagattttggtacgatttgaagctagtccagctaaggaaagagaacaataaataggaaaacatttgcaataaattatgacagaagttattatatatgtagtatgtgaaaatattaggaagctattataacaatgataaatagtagataaatttgccataaacacagatcccagacggagaaaaaagtcttaaccacaagaaaatgttccactcgactgttaattaaataaatacaaattaagacaataatgggtttttacttatgaaaatcctaagaaaatatttagtggttaagctgttggcaaggcatagaagaactggtgaatttgtatgtctgtattatgaagctatttggcaaggtatgtcaaaagctatcaatatctgaataacactttttgactcagtgatctcattcctgagaatttatccacagaaactgattaatgaaagaagaaacatgtgaaacgtgttaattacagcagtatttgtgataatgaaaaataagaaggagaattaagttgtattttccaagtagaacgttgtgaagccattaagatggtaaacacagaggtttttagatatgtatttgttatgatactttgcattgtaatgatctgttatattctaagctgagagcttttcaatggcagggacctgatttttatctatttttatatttgtggtacctagaatagtgcctgaaacctaatctgcactttaataaatgcttgctgaataagtaaatgaatcaatggaaatacaaaaagagttttttgcaaattgaacaaatcagaacacaaaattgcatacactaggataaaaccatgtaaaatatatctatatgcttgtgatcaaagactgaaagggaacaagaattgaaaatgcttctgtcatagaagataacttttcttttaatattgtaataatgcattaagaaaaaccacaagtcaagacaaggaaaatgattaatacatttctcagaaatattgcccacttttgcctgcctattggctgcagagaaactgaacgttgattgcttaaaggagaaagaggagcactcgcagagctgttactggatttgcctagaggctgataggcctttgccatcatctacaataccagcctcctttctattattcgctgccagctaaatcctgttcgtcattctggacttgcttcaaataggaaaaaggaaaaaataaccatatagtctatgatatttacataaaacaaaacgtaaaggctggccttttaatccaaagttttaaaatacgatcaaaaactccccattgttccagtttacttgttatattgcagagactgggcccttgtcactgtataatataaaatctgtccttttctcttatagtgaatgttatataaatgctaaatgtagctcctctctaattccactgatgattaaaaataaacagaaaaaagcaataaacaaaaacccctaaatcacagagagatcaaagcaagaacataatagttttgcaatactgtaggattaatctattaataaaatataacatgtattgtgtatgtatatattatatttttattgattaatagatggatttctctaattttgcaaagctgtacacacacacacacacacacacacacacacacacacacacacacacacacacacacacacacagtttctctttttgccctgacagataagccttaggaggattttgaatgtatggactagtttttttgaaagagttgaatcaagtagagaatcctaaagtcctaaaacatctgccttaatatctaattttagcttaaaatatcaaaatgaatattcattcatcatttatcaatacaatcttatgacatggggccaaggccacttccctaaatatgggtttgctggtttgagttccatctatctctgcatccatagtgcatcctctatgattcccattggtttccttctcaagttctacagccccccacccgcctccaaccccttatcttctttagttgttgccttcacaccaaatttggcaacagttttttttttttaaacattcagatcattacctttatccctcctcaccaccaactctttctcttcacacctgtatatttttgtgcaatttaaccaaatgtgtgctaccattaatgagcaaaaggcttaagcaggtttaggtagaaacaaccttgacccttagtcgggtgaacagcttgctcacctggcaggagcgagtctaccagccctgaatgctcagcctgagccagcctccaaagcgtggtttagggaaggaagggagtgctcagggcagtgtgggcatagtggagttggcaaagcaaagcacctgccaagaaagcacctgccatgcttctggctcctggctggagagtggtggttgtgctgtgaaaagaaatcatcattgtgaacctaaaggaaccagactgccaattcaaaaggaaagtagcaggctgtgaattcctggattgatatttttaaagaaatcattgtgaatacacactgggtcatttttatcctgagtggagaagacaaataaatacaggcaaagttctaattataggaagaacagagatggcgtgtgaatgagatttacaggagaaatggcatttgaaggcccctggaatttttatgcaggctttttggcttatgatgtgtttttgtcattgttgttgtttcgttttgttttttgttttttttttaaagtgcattgaagccactttgtttttctatgttatctagagcctgggaaaggagccacttttcctcttgtgttggattagcttggtcttagccagtctctcagtcgtggcccaagggatgttcaaagattcttgcttttatgtgttctttatggttactttttggggtgtttctcagtggcccccagtcaggctggcttaaagcctaacctggttttgtggcttgcaaagatgataacttccactttcaaagtacttttgcatcttccttcttgtgcccatggaatatttggtccactcagctagagttaaataggcccttgaacgtcatcaaaactttaaatcagtcagacaacttttgtgggtgtggataggcccacatcctcatgtcattttttgcccatgagaagtcaagtttattcaaaggctgatcagttaataggtgatcgaagcatactgaagttctgacctgttaagataatcgccttgctttagaagggtgtgtatctctttgcaaaaagaagataacattaatataaaatatctgcttattggaatttgataatccaaagagcttgggctgttctacaattatttctccaaataactttgaggtgaaaacctctgatttcctaatgtgcagagatggtaaaacattcatattaaggagaaggaagccgtgtttagaagagaaagttgattagatttgaatcatcagcatgcaaaacaggctgcaatcatataaaagtagcatatttgcaagtttaaaggtatttataatagatttgcatagctgtgggatttatcaaatatttcagtgcttacactctgagagaaactgtgtttattgagatttggggattgattgaacagaacctgtcccttgaaacatgctcagtctagtgagggagggcaagatatacacagctaaggtaactatcaacccaagatgttaccagagtggcaaatgatggcattgacgaacgagagaggaatttaaaaataggagtagtcacagagggtgaagaagatgctttgtagaataggtgaggtttcaactgaagatgcagatggtgagtggtatttgtgttaggtgctggaggaaggaggacatggtgttagtagagccttgctctgcattaggggaggacctgtgaaactttgggacctcccctaatgcagacctcccctaatactttaggtgtagagtatagaaagcaggtgctggtggatgcaatgaaatggggttgagatcaaagttatagtgctggccacactgaactttcaaaggagcgcctgtttaaagattcctaatctggaggtttcccaggtgaacatatccccataaccattttctcacctggaaatagcaatgggagaaaacttgaggatcttgattcatcagaaaggttatcttgctggcttgtgttaccatttgttcatattttttaattggaatgatagaaagaccttagtattggactcacttaggaatttggggacctgtggctgtttttgaaggacaggattatcaagcactgctgaaggaagtttccgaaagctctaccagaaaccctttccactctgatgaaaaatcatggatgttgctctgtcttgttgggcagttggcctaagtcttaaatagaaattgtatatgttttcttaaatgacttcccttccaattactctacagatttctcttcgagggccgcctctcatgtagaatagccttgttctcagaagagtgaggggagggaatgaaaatcagcttccctatgtgaatggaatgttctggcccagccagaaagaggtaatcatacaatgaactacacaagaattaggggaaaatattggtccagccatttaggacctagataatgcttgtttatatttggcatagccagctttcccacatcctctgagattgaaaatagtgtaggtgtttatgccttcaggaaatgccccccttaaagatatatttttttttcaccagttctactgatagaaaaacatgtttaccagaaataatttgtattattttcagcgatatttaaaaagttaaattatgtctcagcacatttatatgaagttctagaagaagtaaaatgaatcaaaggtgatagaaatcagattaatgattgcttggaggtggattgactaggaaggggcacagggaactttctggagtgatggaaatgctttttatgttaatagaggtgttggctacaatgggcgtttgtcaaaactaatcagcttgtattgttaagttctgcatttatgtaaattatacttcaattttaaaaaagctttaaaagctgtcttaacatttttttagcgttttaaaaattctcaaaacacctttcccaagtaagagaaaggaacagtattacaattttcatttagttactcctgaaaaaaaaatttgaggaaaattttagcagctttaaggtgtgggcctttccttagactttgatgtgtcacttttcttttatgggaagaatggtaaaacaactcttgaaacaatgaagctgacttcgtttgtctgggtgcatccccctaaccccaggcttccctcaaacccacccctccagtgtgcttctgactggggtttgggtatcaaagtattcactggatgaaaaaaagctatagtcatccttagatgaactttttctgtcttgctacttgtgcccttgggtagactgtagacctgataaagcctccataccccttctcagtccagttgacaggtaaaacttcaggggtgataaataggaactggcctgaatagccaagcactcacagggagcacgccatcttttcagtcacagacttcctctttagtgccttacaaatggggtgcaagaaggggtggggatgggagtattgaagttcacccaggtgtttgcccaatctccaacagggttaagatttaaaaactacttccttggaccctgaacccacttagatgctgttgattgtaaagacatgaaaattgcaaggccctcagatagaaactgttgaagtggttttattccatcgttctcaaacgctaccaggtgtaagctgctctgctcccagctctgggccaaaggtgagattcactcttggggcacggtgaaattgtatcttagcacatttatgtgaagttctagaagaggcaaaactaatcaaagggctccagagctgactgggttggtcgtagagggacacaggtgggatttgttctcagcctagagccaaggcctgcagaagactgtttatgagtggggaacggcatctgcccccttttattattgtcctttccttggggtggaagttataagcccttggtgtggtattcgtaatccctactttgttacaaagagacgcatttctttcttttcttaactatagaaatgcaaacataagcaagcttgatttccaagcaggggctgttcaggctctgtaactgcctctctcttgttggaaacttctcaaggatggagtctttatctgttttgttcagcagtgaatctgtccccaggtactggggcagtgcaagataggtgcttactaaatattggtggaattgggaggaccacacagtcctgggtgtggcagtacctagttaagaacagtggcaaatatagttaggatctctcagttccttttgctcctcacaggaaggaaacctttttctgtgggggaaatcagggctctttaggcccccatggaggatttttcccaataatgtctctgccattcattcattcattcattcattcattcattcaatgtgtgaggcactgtgctttactcttagaatgagtgaatgaatgaatgaatgaaatcacatggcagtgtccgtgtcctcgtctttacacaggaagttgaactagaatatctctgaagagggatagtgtgaggtatcatttttctcttatctccagcctcagtctcgagaccaaaacagctggcctggctatagaaggaaatagtactgaacgactctcactggtactggggccacccccaccacccccatgaagggctccagctcacagaaaaatgagcatcgtgcccatggtgcacctgtgatgggaagtgtgtccccaggcgatgagcagtggttttattgtctgcccctccacttactgcgtggttaatgataggcctctgccattttcccataggccactcttctcagactgtgctgtgacagtgatactggcatctgagggtgtggtgaggtgaagatacgtctgttttcccagcagacagcctgcttttcctacacatcaggaaggcttccctcagggatcttgggcaggagccacttattactaggaataggaatgttccagacatcttcaaactaagtgggttggaattggcccagctgccccgtgctgttggggattatgccagggactgctcatttgtggttcatgcccttgattttctcctcctgctatgtgactcctgggagagagaaggacattttctggtttcttattcagtaccagcacaaaggactccactccacaaatcctgtgactattgatactgagactcatggtgaatcttcctaaccatctaagcctataaaaagctccttgaaaaaataatatgtgtcagttgagttggcatagaaacatggaatgatttcagtggaaatgctgcgaaatgccacgatttggtatcaaatagtcgttgggacagttgtgcatgaatgccgtcatctggattctctcccgaagattttgtgattgtgcaaatgtaattgccactctgtaagtctgtatcctacaagtttccttataaatgctctaaacttatcgttctggttatctccattccacaggctccatcagcaaccccctttctcatacacacctgtcccctaagtatggctgccatttcttcttctaaaagcctaccttaattttgatttcttttttctcaaagccttcctttagcaccccagatctcagtgagctcaactttgtgtaacaagtttgatgtgtgctaagtcatggtcttttctcatctgtttacattgcattgctaatgtttagtcatacctttctatcttggtagagtattcacttcttgaggagaactaaggacttgtcctatacagttctatgtcccgcagcccctagtgaagatttgtaatgcatatatacttctaacacagattgagatgctgccctaaagacgacaactgtgaagtgtgttaattattcccatcatgcagataggaataaaacggggttcattttggtaggacaaatttgcataacgtcacacaactactaagtttcaggatagaaaaaattcgaactggacttttgactcaaattttctttttcttttttgtttaaattattttagcttttacattgtatttattaatttggattggtaatacagactttcctcaacttaaaatgggattatgtcccaataaacccatcataagttgaaaatatcataagttgaaaatgtatttaatacacctaacctaccaaacagcatagctcagcctagcctaccttaaatgtgttgacaacacttccattagcctatagttgggcaaagtcatttggcaaaacagtatactgaagagtgtcggttgtttaccctcatgatcacatggctgactgggagctgaggtttacttctgctgcccagcattatagaagtatcatactacctattgctagtccagaaaaagatcaaaattcaaaatttgacgtatggttcctactgaatgcatatcacttttgcatcatcataaagtcaaaaatcctaagtcgacctattgtaaattggagactgtctgtacgtgcacatggtaaaacaattccaaaggttgtattataccacaccatacagcttgtaacttaatacttgcttgttttcaaactgcccttattttcctccaagaagccagtttgctattctgacttctgctgtactactagtggctctattacaaaatccagggccaatttttttacgcttctgtcacccatccctgctagttgatcactcaaggccagctcagacctcaaagggcctcgaatccaaatctgcctcatccattctcactgctcccccgactcagccttccctccttatccagatatcatagtctcgctgcccttcctacctacctaccccctttcggttcatcttagggtaacttagaacccttcagaaatgtacaggaagctcttacactttctgattgagttcttagcctacagataaattcttaactatatttttttaggctgtttagttagtttggtagtctggggaaaccattctcagtttttagataatgcttttaaatgcataaaataaaacgcataagattataaagggaatgatttatattgaactagttatcaaattattttaagaccaaattttgatatagtaatctatgggtatccttattaatagactaaatagcaaaggtctcccagtaggtgtaataactatcaccatttcaaagcagcaatgagcacatacgatattttgagatacccatagcatctatgatgtgatatgaaaatatctgtggtttgtttggtgatgagtcacaggtccttctaatattggtgtgttacctaccctacgttcataaccaaagcagatgccaaatttcagttagaggctaatgaaaatgaagtattaattttgtctgtttgcatttgtggatcccaggtaaacacccccttctttagcctgaatctcaaggctctatgtggtctttttttcttgttccctgttaactttaaagccattcagtctccctgtgtgggctctgcatgctacactatacatatgggaggcaaaattggaaaccaccatgtctaacctgacccatgtatctctgctcttttgtttgtatctctgcaggtagaggaaggatggtgggaaggtgttctcaacgggaagactggaatgtttccttccaacttcatcaaggagctgtcaggggagtcggatgagcttggcatttcccaggatgagcagctatccaagtcaagtaaggaagtctaccctaccaagcaggagaggggcgggggaccggcaggctgtgctccagcctcccttctgttctgtatcctatgccgagaggctatagtaaacgcttacgagtatttttttggttatactgccttaacccactgtggtttaggaagttgatccctataaaggtgtgacccgtagccacacattctgtatgtctctggataggtaactgccagccttcatgccctggtaatactgtctcatgggtggcccatgttgctgtgcctccatatacttctagagtgttgcttactgtaagttcataattatttaaaaaatgaaccaaatgggattgtcagtatttctcagcatcccttgagggacttggagaaaaattaccaaagaaaaaaaaattactggtggtgagaagtgaagtgctatgacaagatgagtgcatgccaatccccttaaaagtaggtcaagacaactgagagtccaggtcccaccttgggtggtgagcatgtgtgtccttctacgatggtgacaacgaacttcaggtctttctttctccagggcctgaaggtctccctccagcttctctgctgccctttccagctcacggagcaaaaggtcaggaccgggaaacttcgttctcccagtcactaacccaactgtgggcgtctgtgtatctcttgtgctgtcttgagccaaggtcatgggcatgaatgttgtaggaggctcgactgtgcagcactacctggggttgcagaatttcctttctgacaagaggagggcagcttagtcctgcccaaatcattcttaaatgtcttcctttttcatttggaaaaacctgacttgagtggtgttctcgtgttagtttgtgtctcatttatttaaccagtagtatgattagacaagtgtctgatttggaggtaacgccatttgcagagaagtgctcaagcgacttccttcacttggtgtctcagcagctctggatgatgtagcctgacataccgagaaacagcagcacttgctggttatccagtggcttcagcagtgctccttccctccagtgccaaagcctgggaccctactacccctgaaccccattccatcctagagtctatggtaggaagcactggaaggggttggggggggaaacgaggtgtcttggagctcctgttgccttctctggctcagggcagggggattctctattaacatggcccagctgatgagtactactgggaggggagaaggtgtccttgatctcccattagtggaaattactattgctttcaaaatccgtgttagaattctagctgccctggtgtcttctcctgtactctggaataactattgtacctggtaattagatcccataataacaatactctatgtcagggacattgtggattaaatgggattttttggagagaggaccaaattgggtcattataacattatttccatgaataaattcattacaagttccagtagcaataatgtgcataaaccaccttgctccatagcagacccataataaatggtagctctcactgttagtcaagataactgttgagacataaccagttagtatcagttgcttggaggttgcttgcatactgagcgatagcatgttggctgaggcattgtgactgcatttggaaattactttggagttcctctactgatgcagaggaggagatctggggaagtattagacaacctctttggaaaagtcttgacatattggtgtcctgccattttagctatgctctcagagctggaagatcagaggagtaatgcctcttgtatctttagaactattgaaacaaattgacttctctcattccaagtcagtaatatggacagttcaccctgtctgacccctcagctaaaggcatatggtgctgcaattcctggtacagaggattaggaggttgggcggaatggtcttcccatttagcattatgtcatcacctgctcagaaggggcattttctcttctggagactgttccccccaacacacttactgaattaaaagccttccatttcaagaccaggagagcccagtggtttcagcagccatgtttagttgccatttttgaggggattttgaatcccctggagaggcatggtcccctaacaaggatggctgcttctgataaaggatacatggcttttgtaatcttcctgcatgtacagttaaggaaaagagggcccatctctccatcggttggttcatatccatctatctatccatccttctttctctccttccttctttcttccttctattcttcattcattctgtctttattggcaccccattgttactaaaacactgtccaaggcactgacgatatacagagacaaatcagacagggtccctgctttcagtaagctcacactgcagaaaggggacatgcaaacccgagttcagcaaagtgtccaggtgctctgcaaagtaagcatctgaagaagagtggggcacaaagaggccagtcccatggggatgtggggcttcatagaagagcagatgtgagaataatgaatagcttgctaaattgaagtaattccctgaaagagagaaatagtatctctcagtgttctgacagaatttccagtagcaggccaggcatggtggcttatgcctataatcccagcactttgggaggccaagacaggtggatagcttgagcccaggagttcgagaccagcctggccatcatggtgaaaccctgtctctactaaaaacaaaaaaacaaaaattagctgggcgtgctggcacatacctgtaatcccagctacacaggaggctgaggcatgagaagtgcttgaacccgggaggcagatgttgcagtgagccatgatcacatgactgcattccagcctgggctacagaaagagactattaaaaaaaaaaaaaaatatatatatatatatacatacacacacacacacacacacacacacacacacacacacacacacacgtatgtatatatgtgtatatgtatatgtgtgtgtatatatatgtgtgtgtatatatatgtgtatatatatgtttatttggtatttgcattcttcacatttctgcttccagaaagtatttgaagtagttactgagttgaattttgtgtaccaatggatgaatatgatagaagaaacattggcattatatttataagggagtatgccaagactgcttgacacatggtaggtgtttaataaatgcttgttgaatccccttttactataaggaggcatttttatttttgaatgacaggtgaaaatcttttgaacttgcttttctcttattctgatgtatttttccatatcgtggttggttatgaaagtctctaaactttcttagatctttgtttagggtaatctagtctatcaaggaaagaattgcaacgattgtattggtggatattttatccattttatctcagagaggaaaatttatagttatgtagtagcagaaacttttcactgcatatttaaatttgaaaacatctttaccattttcagaacttatgaaaccttaaaggtagtttttcaaaaaagattcttataaacttttttattattgaaaatttctaacatcaacaaaaataataatagtataatgaacctctgtgtacctatcactcagcttcagcaattatcaacctttggccaatttgttaaaattatagccctctgcacgctttgtccatattatcttgaaggcaaaccccagatattatataatttcattcataaatattttaacatgcatcagtaaaagagtgtctttaaataccatttatctcacacacataaaattatggcaagtccttagaataattaaacacatggtcactgttcactttcccctaaagtcttctttattgcaattcatttgagtctgtatccaaataaagtacatacgttgcagttagtcagtatgtctcaaatctgtttgaatctatagatttctccttcatatctcctttttttcttgtaatttttttgctaaagcaactgagcccctttgtctattaatttctcacagcgtggcttttgccgatttcatctctgctgtgtcattaaatctgtattcctataaattgatcattagatctggggtcttgattagattagatataaatataaagcctgaaaatatatatatatatatataaacctgaatatatatataaaacctgaaaatatatatatatatatataatctcaaaagatatatatatatatagagagagagagagagagagagagagagagagcgacagagattgagtgcgcatgcgtgcgtgcgtgcgagagtaaacctgccacctaggtggtgatggataatccacttggaggctcataatgtctggccgtcctactttttgaatgttagcagccattgataattgtctcccaaacctagttactcattaggacttgcaaagaggtttcaaccagaaatttaaaaataataataaaatgggctcccatgtaacagatcaatagtccaaaaaagtgtttagtaaattaggtttttaaaaatcaaaacagccaagtggttgtgctaatagtgtaggcagaatcttatgatgttaaggtggaaaggaatttagatattgtttaactcagtgtcagatgagaacactgaagcccagtgaaattaactcccaggcttctgagtgatggggagaaaatgacatgcaagccttccatacacattctggtgctgcctccattacacaaatagtttacctttccacaggtcatctgacaaatttcaagcctgagtacagtttagcttatttcttcttattgtcacggatcatgattagttaattgccttttcagttacagttttgcacatgctactgttgactaaataatgtgcagtggcaaagaaatccagatacgactgttgtccaatttcaatttcatacatattttgccttacatttaagacataaatatgtcttttctttcacatcctttgatattatttgctttcaaataatagttgtaaaactaaaagtgtccctgttttttaattctatagctacagaaacattttcagttatttctcacaatcttcagagggagaaagtttgcattttctttctgtaaccattaataaccatgagttttctgttgttattgaatttctcattttcctaattccttatttaaaaagttgaggttctgataatttagtgacttgtcaggctaagacaaagatgaagatggaggccaggtgtggtggctcacacctgtaaccccagcactttgggaggctgaggtgggaggatcacttgaacccaggagtttgagaccggcctaggcaacatggtgaaaccccatctctacaaaaaatagaaattagctagctatggtggcatctgcctgtggtcccagatactcaggaggctgaggaaggaggattgcttgaacccaggaggtcgaggctgcagtgaactatgattgtgccattgcactcgagcctgggcgacagagcaagaccctgtctcaaaaaaaaaaaaaaaaagagagagagagagagagagagaaagatggtttttaaaaatgtatagcaaaccactgccatgatgcagaaataattgtgtttcattagctgtaagaaatggattgctcagcgtcccttgcatataaaaatgagagccagtctgacaaatcccactctgtggcatcattagactttttttctttttaatattagatgatatttgtttggagtatgatggtctattagcaatgaagaacgatgagcaaattgatgtgatagtttcaggcaaaattagatgctagcataagtgtatagttttgtgtgtaaattttaaaactcttcccttttatagtgtttgctgccttcaagtactaatatttaacagtgacagtatactatttcccccagtaagatcaacgtcactcatattcataacctttccagttggctgcctcttttgctcttcacacaggacacctatgtgtcctcacccagccccagcccagactacatctcaaattgccttgctgccaatgcacagagagactttgcaggaaggcttaaccattcagagacatcagagccatggtctacctcagtgactctcaggcttggtgttagggaagaacacatggaagttttagtgtacttaaaggaacattatcgaaatactgcctttaaaaaaaatcttacacttcctttttttctgacacttgagaggactgctgttgttaacttttggagggcctagctcacaaaacagctgtgttctgaggagtaatggtgacttaatgactgaagttaagcagaattgcccgaataaaaactagccactattacttgctgcacttttgtcatcaaagtcctcaagagcttcaaatctagcaagaacatttgaaactttgttagtcttcagattattcttacacagccagtgatttgaatgcctaagtttttgctttaattggatagaatgcatcggtcaaaaagggcacatttcaaaaggagggtataccaccatggctgtaggacacggaaattggaaatacctgatcccatttaagttgttggtcttctgatgattcacaattcctttcctatatggggagtgccaaggcccagaagctgacagtgtggtttctcttgggtttcccattttaacatggagtgtttctaagaagtgagacaagttgctctctcccttcacttagttctactccctgcttctctgtaaatgtagcctagctttttcatcctccagacttattaggaagctgtatgactggcctccagtttgaatatttaattaacaagccataataaaatttatttctcagataatttaaagtaatatgtttattaattgagtttgcctttagcaaatcattttgcctgtcggtggtactctctgtagggcatttgtgtgtgtgcgtgtatgtgggtgtgtgtgtgggtgggtgtgggagggtgggaggatgggttggagtacactcaaaccagggcagtatgtgtgtattctgtatagttgctcatggttccagagatatttgggctttagccaagtgttcagccttatgctattgacaatctctacctgtaacagcaaaaaaagataatttgacatttgacactgggtgagtcctgtgtcctcatgcttaagtacagtttcatgactgacacagcagaatcccaattaagatgttttgagaaatagggttttctggtgtccttggttctaagcagaaaaccccgtatgtttatgtggatgccactgttggtttcaaacctcagtggtgaaacccccctcaccagtatattaatacattttcttgcttaaaggtactgagggtgacagatcttttaaagagaattctgtgtcttgtttagaatcttggggacatgaatattcgtttttatcatgtaggtctctaggggtagaagataaaggataatgtgtctaaatctgtattatgcataggtcgtattctccaaagagaagcttgtgctgtacaattgagttaattaaggagtccaattgattggattccctctggttaattgaagttttcctattctttaagttacaatgttgaaagggcttccaggtttaaactgggcataatgtacatgccagtcatttgcagaggcaagccccaatttctgggtgcttatgccatactggttgcatggggactttgggctcattctgtaacattcttaaatcctgcctaatggtctctacttaattttgtggatgaagctcttgcagcagattcattgaaggcaagttcagttaaagactcttcctcttccttcttttgccatcatttgctccctcctcccccctctcttgtttttctctccccttctcttctctcattcactgtcaggaaagactacctttgaagggacaattctgtaccgagctgcaccgggaaagacggagggccacagacgctattacagtgagtgaccttaacagcagaaggcaattgtaaagataagatctgggtacttgtgttttttgatgcagctgccctttcctgagctgctcatgcttatgccaagtgtctgtgtgaatttctgatccaaggacatggacttatttgtctaagtaagtgccatctccttggtgtgtgctaagaagcattcccagcaccagcccctggcgcttttgtttgctttctgcctctatcatgtatgtgatatgcgtgcatgagccatacgtgcaaacaaaggagcagtagcatttgtcgtggcatatgtatttgtaccagtttctctgggcttctggggtggtgtaagatggcttcctgcagagatgtcaacctctcatggttattgctttctctgagtgggtcactggaaaccaataaaccattttgtcattgtgtggttcaaagaagtaagaatttggcatgaaagtccatgccagaaatggcattttgctttgctcactcagccaatcaccacatggcagactttttttggcaggaccaatgtgtagccttttgtgttgtgaaataaggctgccaaaagttgaggggaaggagatgaatgagatgcccttagaacagttcttgccacacagtgagctccatccatgtgagtgttaaattaaaaatagataaaaatatctcatggatctcaactgatcaatgctggaagactgggtacattccacaaaattggacagttaaaggactctcagaaacaaaactgaggaggctttgttcttttttttcaccttgaaggaaaagcatccacctttgtgtgcatatacacatatgcatacatacctacgtgtatggatatgatgagagagaacgttgaaacatgaacaccagagccatgcttcacaaactggggtcaagttttttttccttgccactccaccatgggaagatgcatggccctactgcacatgacctcactacacatgcagggtgccgcctgtgcctcaccgtgggagttttgacagcacctagattgctctgtgccctggtcatttagatgactccaccaccagccacatgtctggaagttacaccagtgcacactgttaaaacactaaagcatcgccccagacaccacactttctgtagttctctcaccactgcctacctgtaatgagcccttcatgaaccagcccccgtccacagtccacactctgggttgcaccacccaagagtgtaacctggcattctgggcctgacatggggacattttatgggataatgtgcatgatgggcacgagtcactaaaagatatatcactaaatgaacatgaaaatgaaaagtcacctttctttccctctaaagggaaggaactagattttgaattattttaccaacacagatagttagatatttaatttatacacttaaaagtgatagaaccagcctgccagaagttctggaagaaaaatctgctgtgtgtttccttcccgggccatgcttgtgtggttgaatgactgtgcaacctctctctgtgtaacgtagagtatttctcacggtgattagtataaacatattaagatgagcccagaagacagtaaatcccaaaaaccagaagctcagtgaaatgaggatggcagtggctgaaaatattatggttctagctaatggtgaatgatagaagaacccttgaaattcttctctttgaaaaactaaaatagacttgccctaatctgtttgccctgctgccttctggtggtgatgaggggagcgtgctgagggaggggagtggtgatggtttctttccactaatggtttctttatttcacccttgaatggctctttccaagccagaaaggaatatacaagtcatttatcacatagaaagaatccatacggcaaaatgagaacatgttaagggggaaatgacacaatatttagactccaaaattatatctccagcagggatatttgcaaaaacaatgaacagataaacacacaaatggatagatggatagctaatgggggagggttcttgatgtttacacactctaatccttcctgtgaattgcagccgacccccttgttgtgggctgttccccattcggtcctgtgtttttgctcacaaatgctggttttcagttaattaaaatgtacactggggaccttcctcctcccccacccttttggcttaaaaataccattttatggaaaatgacaacaacaacaaacaaaaccattgttttaaggatttgattctgaaacgtgttagcagtttataatgacctttctatattttgtctgttttcatttaacagtttcttcctgcactgagacttccttatttgaatgacttccacattttatgagattttatgtgagcaagtatttggtgtatcattcttatggactaggaggccaccttacctgtaggaagataatgcacaattggctaatagagaacaacatttgatggcgtactttcatttcaagggcatggttatgatcaggagttatgtagtaaatgttcaggagctattctacacatctagaggctttcagagacaggttaatgacagagtttagtattccataaaatattctttgaatcctgccctttgatggcataattgatatactgaccatcaaaggaagaatacacccagaaattaactagacacaaataggctcttccttttaggaacatgattgtgggcagagccttgggaaaaaagaatctggggaggtaagtgtccatgttgtcttgctaataactattttatgacttccaaacacatgccacagaagatcaaaggaagagtgtcatgtccccagtgttcttctttggaaagggattcagctttgggaaaacactggtgtttaaaggagagaagaagggctgtaggtttgggggattctggcctctgggaggacggcttcctttccctctttaacaaacatgatcgtcttgctagtgaaaccgtcttaatgtcaagtttggtttaatgctttcctagagaaacatgtctgcatgcatttattccttgtgaagccatccaaaaagattgaattctttggcagttataattttgtgtggtttctttaattgctcatttgtttaaatggcttttagctttacagtttccctttaggaaatgttactttcattgctaattgctaattgacatgagtcatagagattggaggtacagtatgtggtactgactgggtggggaggcaacaaggtgggtgggaagggttgctattgcacaggctatgggaaaacaaatttggatcaaaaccaggctcccggctaaagaggggtgaatttcacatgtacaaagatatctgctttggaattagattttctgaaaagttgttttgattcacatcttaaaattaaaagtaaggggtggggagatcaaacaaaactcagagccagtcaaactactcaacatactgaatacaaaagcctagtgcaagttatcctgtgcccagtcacacttttagaggtggttcctggctggttgtgaagttcttcttcagggctctggctgatttctgagctctttctctccccatccccactcttgacaggtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaaggtatgttcgacagtttctatttgatttcaacttaatgtggaatatccaaaagtacgttgtggggtttggtgctggaggcttccaattcctcttttagggtttccatgtcctcatgtactagttgtttgtcctgtcttcttttttagctctccctctgtgtgggaacgacttccctcaaaaggctcatgctctagtttgctgctttctttcttgctgatctctctagggaatgcttctcaggatgactttggaaatggaccagtacttctctatctgcttcccagaaaaacccctcattcctggacccgcctaagtgcatgaccctgacacttttcagacactggccaatctctctccgctccttgtacatttctctagtgctttgtgcttgggtgtgctgactgtggttctgcactagagtgaaggaattgtgcaccttttctctaagagttagttggagataatttcagactgttgaaaggaagtctcccgcaggtgtgaatgatggagatggcctgtgctgtgactccctgggttgttcccttcaggaagctggctgtttccttctgcctctggttctgggctagtgagaggcaggcagcatgttgctgctgagtacgcggttaccacagcaacacacccagagccctcgcgcttgtggctgccgatgacgtctactgtggtatacttctgagcattgtagccttgcttaggagttgataaatactgtggaattttccaaattataataagctactctcgtgctgtgcttaaggcatgtttgttaattcgatttagtgctgaaatttttgctttgacatttgtgccagcagatttgggggacggggtattggcaacctctctaattcaggtttatgggtggcttttaagtgttgttgtttttttttctttctttttttttttttttggtgggataacattttaaaggttgcatcatcttctgcagctgtaggacatccacccctccacccgccctcagcaaccttgcccagtgtcatcatgcattagaagcagaatctgaaaaggaaacttttcgaacactgaatccctctagagatgagtcaggcagaaagggcagatacctagaaattaaaaaccgtttcatttaaactttttttttcaatgttgaagtttctttgagtcagcattgttcctttcagcaatcaatatatgatatttttcaagatctgaaaactagtgtcccagctcttgagctcacttctgttgcatatggtcacattcagattcctgtgaacatttacaaaagagcaagtccccatcttggaaaggaacactggatgcagtttttcttcttttattcaagtggttgaagtgaaaacgaccattgactcagtcagcaaacagttcattccttttgtttgttttatgattcctggcctttatcttctttgtgtaggaggactgtgtgtgtgtgtgtgtgtgtgtgtgtgtgtgtgtgtgtgtgtgtatgactcttattattgctattaatattagttttagctgccaataataaattgagttactgttgatagcaatgtcaatgtcaaatataatacttgaaagtttttatctcagcacatttctttcctgaacctcagagctgtatgtccaactgcctgcttacttcagtatctccacttgaagatcttaaattcatatccgtttgcctaaacctgaactcatcgtcctcctccaactgctctacccacagctttccccatctcagttgaaggcagcgccatctcccactcctatcgctcaggacagaaaccctcaggttgtccctggctctttctctcagctctgcctcctaaatatgtccatcatccacctaggtctcatcacttccactgctccttaatagggatttctgcctctccccatccccctggagtttagtcttaagagcgaagccagggagaacctttgaaaacccaagtcacatcatgctactcatctgctcacacccctaccaaggctttcctgagaaaaaaagtgagacccgaccctcgttactgctgggacttcctcccccactgctctcccttcactttcttcgttctgggtccttgctcttcctcagacatgccatgcacactcctacagggggcatttgctgcaatggtctcctcagcctgggccactctgcatctacctgcccacttggctgcctccctttcctccctgctatcttagcagaaacctcaccccatcccccttcctggtactaaatattttgttctctgtggcacataccatcttctaacagatttatttttgttatatatgtcacttattttgtttgctaatctattctatgtgcttagaacagtgcatggcacattgtaggtgctcaataaatattgttgaatgaataatattaaaatataaatgctgcactttagagattacagacatctctagaatgagagtattgggtgagataatatagcacttgtgtagttgaaaatatatcaattgtatagttcactgcacctctgtgaagcagatagttcatttattgcattgatattggtgccatgaagtgttaacttcatcagacacatatatgtgtgtgcgcaagtgcgttgaacatccctaatccaaaatccaaaatgctacaaaatcgaaacttattgggcaccaatatgattctcaaagtaaatgttcatcggagcattttggatttcggatttttggattagggatgctcaacctggatgcattctgctgatactccacaatgcaaaaagaaaaaaaaaaatctgaaatccaaaacacttctggtcccaagcatttcagatagggatatttgacatttgtgtgtgtgtacgcattcgtgtatgcatcttgattcctgatttgtctgcagaatgaaaccatgtgctggaagctccctaaacccatttctcatgtggagcctctggggaaaacataaacttcctagcctgctttctgggtgtggacaatttttacaacatctaagaggatttgaaactatctccaccccatgttgttggcgccatggatagttgcatagatttatggatctatcatgttattgtacaacctggcacaaaagccgataagtgtgattctgttttattagcatacaacctggttttcatcacttttgagatggttatgtgtctaagatttatgtctaaggaagaaagcttcctttgagaattgagctcactgttttcatttttagaagtgtaaattggatcttgcgtgatagcattcagtaggtgaggctcaagtaggtctgctcaggctgcgacagttggccttctgaaatgtctggcttgataacttggatgagggaaaaagggaatctgaccattattaacagctgtgagcatcatattatacttttcgttcaggtttgtgaagttttttttttttttttttttttgaaacaagagtcttgctctgttgcctaggctggagtgcagtggcacaatcttggctcacagcaacctctgcctcccaggttcaagtgattctcatgcctcagtctcctaagtagctgggattacaggtgcacaccaccacacccagcttaatttttttttgtatttttagtagagacggggtttcaccacgttgaccaggctggtcttgaactcctgacctcaagtgatccgcccaccttggcctcccaaagtgctgggattacaggtttgagccaccatacctggccaagtttgtgaaatattaagatccacttgtctgagtcagtagataatcttgtgcttatcttatattttaatctatattaccctacccagagttaatgattagattatacaccaggagagatattgtataacatccctccaccaactgtgaatagataaatagttcatgtaggtattcttgtttctcttatcaggctataaggaaggattccgtttatgaatcttttaaataccaccaagtggatatgtctccgaatgatttgctgaatgtaccatttaactgaaatatttacagctgagttgatttaatgtctgggacttgcttcctatagtccagaagatgaaagagtggggcatagaggagacattgatcatgagttggtatttgttgaaactggatggtgtatacatgggggttcatcacactctatttttgtgtatgttggaaatttcccttgataaaaggttaaaggggggtggggaagaaccttggagaaacatgtaccatttaaaccaagctcagatgtaagtatgtgctgtatcaaaataatggaaaatgctatatggctatagatgaaccaggttacaccttagaaaatcatagggccatagtaccttcatcctagctgattgacctcgatgaagttggcctcagctgggccatctgtaaaatgggaatacttttttttacctatcttacctcacaggacttaaaaaatatatacctgaaaatactttctaaatatgactcatttcaactagcatgtattgagtgctcactaaatatgctcagtactgaggatacagtcgtgagggagaccaggtcactgccctcagggagctacagaaaagtaaataaacaataataatagagtataggaaatgccataatcaggctgagaacacagtgttgtgctgtaggagccctcaggcatggcaggaagtggtaagttgttagggaggctggaaggtgtgtgtccgttcatgtgtgtgtgtaccagcttcctacaggaagtgatgtttaggctgaaaaccatgggtccagtaggcgtagagttattaaggtagggagagcaatatctataaatgccctgaagagggaaagagatagcacagatgatgtgtagaggctccagcaggaagcggggaaagaagcagggcccagatcatgaagagtcttgtgagactcgttagggagttggacttgatcttgagagcaatgggaaactatcaaagtgttttaagcaagagagtgacacgatcagataggtggtttagcgaaagtattccaactgcagtgtggggagtggattacagaagacagggtgagtaaaattcagaagagaggtaacagaaacatactggctttcctgataaatagccccccactccaaatctaggttctaaaccagttaattaattagatgagtgagtgaatggataatcaaaatattttgctgatttttttttcattatagatatccagttgacccagcactgtttattgaaaagattatcctttctacactgcacagccctatcaccttagtcataacctaagtggctatatataagtgggcctatttctggactctgttctgttggtctttttttccttgtgcccattctatgctgcctatgtattcctcttcaagattacctaagctgttcttggccctttgcattttaatttaaattttagaatcagtttgtcaatcccccatcatcataaaaaaaaaaaaaaacctcctggaattttgattgagattgcattgaatctatagacacttttgatgacaattggtacctttctaattcatgaacatggtatatccctctatttgtatagattatgttttattttgtgaaatgttctcaagctgaacacttatgatttgtgatctctctgtgcatacgttttatttcagtgtcattactgatgaaggcaaagttggaaggtatagattagtgtgagaggcaaatgggcctgccagctgattcccagaattagacagatttgcccacacaatctcagcaacattggactaactcaggccaatgtgagatagaaagacctgccccttgaggaacagcagagaaggctgacttccaagaggaggaaagagaagagctaagctgagcacgcccagtatatttttcttaaattcacctatcagataagtaatttcactctcccagggaaggaaacataaaggggaagagaacggcaggagtgtctaattgtgtccagagagtgtccatttgaatttctttacatagaaggggacatcaaggtaagggatgtattaacagcttgaactattgtcatggagagaaatggatggtttggggaaatattttgaagatagaatcaagtttgatagtatgtgggggataaagaagagggaggacttgaagattgtgccttcggcaactggcttaagcagctgagtactattttctgattagaaaacagtggagagagaagatatttggggaggaaggacatgggttagactagctggatttggaagttcttgtgggactgtatcaagtagagacatccagcaggcagatggatacataagtctggtgattgggagagaactgtaaatgtaggtttcagagtcatcagcctagagattgggctggaagactctgagcaagaaggcaagcccagacgagactgtattctcatgaatacaggtggtacctctgtctcccacctgtggacctgagagggaatttcttcatcaggctattttcctgtgaccccagtctggccctactctctgtttctaaactccttccctttttatgagtcacttagatgatcacttctgaccaaccacttagggaaaggagtgtcaggtattacacatggataggtaagttacagatactcgagtgagtctcaggacctaacctgacatggctttatatagaataatgctgggtttttggtgccagctcattccgtgtcctagctctttaggcactaccagtcttggcccacttaattattggaaaaagtagtcttttttgccttactggaaagatttctaaactgaatggtttgccaggttggttgtttactggattccctgcggagaaatctttcaagaagcttctttcccatggtcttcctgtcttagctgatttccgttagtgacttctgacatctctctcttgaattctgtctacactttctacaaggcgttgtgtttgtaacagcctctttttcaactcttgtcatcttgaatctcatttatagaattatagtcacccaaattaatgcctttatggtatccacattgtagcttttacttgggacagataattagaattaaaattgtgtataaatgagagtgactaatcaagtttttaattagccaaattacagtaagagaatttaagtattttcatacgtatctcaggtagtctttttttttgtatttaatttttgtgggtacataataggtgtatttatgtggcacatgagatgttttgatacaggcatgcactgtgaaataagcacatcatggagaatggggtatccatcccctcaagcatttatccgttgagttataaacaataaaattatactctttaagttattttaaaatgtgcaattattattgactatagtaatcctgttgtgctaccaaacagtaggtcttattcattctttctattttttatgtacgcattaaccatccccgcctcccacccagcccccacccaggtagtctttttatccattctagtaaaaatttattaagctgcataatcatataaaattaaaacatgtcaataaggtgatgatcttagttccttaaaaatgagagatctatgtcctaatcctttgaagactagaaataagctctagagaactccagaagctaatgagatatatactctttgactaattaaacacaagggtcaaaaccttgttgtgattatctgagacctagagtattggctgtccctcgttttggttgaaaaataagattgtgtctcttgagttgttggaaaacctgtggtttttaatgagcagatggtattaagatgcccactggttgcctgggttgaatgaagtgtttgggattttcagactttggcttctctctcctcagagtgtctcagttttgtttcctgatctggaaaaagtaaggaaggaggaggggagttggtagggaaagggaaacagaaacagtgaaccagtattacaggattattctttgtcatgttgggtgctgctttctgttttatatatgtttgatgtgaactttctaaaacactcagcctagcgtattttctaagaaatatttagttgcagccagattgtcaccaagaatcatattcccagaaggttttcaaattgtgttaagagtatagtggttggccgggtgtggtggctcacgcctataatcccagccaaggcaggtggatcatgagttcaggaaatggagaccatcctggctaacactgtgaaacccagtctctactaaaaattcaaaaaattagctgggcatggtagcatgcgcctgtagtcccagctacttggaagcctgaggcaggagaatcgcttgaacccgggaggtggaggttgcaatgagctgagattgcgccactgtactccagcctgggcgacagagcgagactctggaaaaaaaaaaaaaaaagtatagtggttattaaacatggaggacagatagcccaggttcagacttcaactctgcctcttcctgggacaagttacttaaccactcagtgcttttgattcctcatctgtaaaattagagtaacaagagaatctaccccagagggttgttgtgaggattaagtaacatgtaatggttagagaagtgcctggcacatagtaatcacttgattaacgttagttattattattgttgtccttattgttattagagtagaaagagtacctataaatgacagtacattttccagggttatttctatttatttatttatttatttatttatttatttgaggcagggtcttgctctgtcacccaggctggagtgcagtggcatgatcttggctcactgcaacctctgcctcccgggttcaagcaattcttctgcctcagcctcccgagtagctgggattataggtgtgggccaccacgcccggctgatttttgtatttttagtagagacggggtttcaccatgttggccaggctggtcttgaactcctgacctccggtgatccacctccctcagccttccaaagtgctgggattacaggcatgagccaccatgcctggcctctttaattttttattatggcaaatttcaaactgcaagaagtacaattgaattttgctatatctgtgttagctgtttgtttcatatcaccaagtcttaaatgtcagccactagaaagtaagtgccataatttgggaccttgtctgtgttagtcaccatttacagtttatgaaaatagttgtcaaatgatagttggccctcagtaaatatttgtggactggatgaatgaagatactgttttgtgctaatccaattctggttgggatctgcttgtggtctagctaagattcactcttccatttgttcattaattcactcattcattcattcactgaagctttattgaatgccttttatggatcagcagtgtgaagctttattgaatgccttttatggattagcagtggtatctctgggatttgtatgtaaatgaacaaaggggtggcaatccatttggaaagggattggctaaatggcatgtctagatgttgtatttgcatagtaagtgcggtttttttttaacctgacaggttatttatttggggtggagcagatctggtgtggttcatcggaatggagttaacacctcctaccctaagtcacaccttggatcagctgtcatatacaggtttctcatttaatgctttggattgtccctacattggagagaaagggggtatgtataaaagtcattataatgtaaggggaaagactagcagacgcatgtccaaagcatcaatgagaatagaaaggaagaaactactaactttcctccaggtcaagaaggaagggatgggatatccttggtctctttttaaggaatgtggtatttgagcaaggtgttaaaagacgttgggaattcatggtactagcagtgtgcatgtggacaaggagtgagcatgagtatgttgaaggaagaggtgggttgggctggggtgcaggggctgtggtggtggtagtggaggaagtgggcagctgaaggggaggtggtgcctcttcctgcagggctctgccagcccactcacaagctgcccttcttctgggtgggtgggcaagttggtgaaggagttcagttgggcagcagcatgatcagatttatactttagagagataactggggaggtgctgaggaatgtggactggagatgggagaggaagtagctgggagacttgccagccccggggctccatggtcgatgactaattggccaggcaccaggaacttctagtagctcttggaaaggggcagatgggcccacctcatgcacactctttaagctggatcgccgttgcctgggttggcagcaacactgacaaaagagccaagtttcctttcaaagaaaattcttttgtgtattttgggaatgaaaaagccaggagtcagcattctactatcttcattaatagataggctaagaagatagagacaatttttaaatttgaagttgagagggccttgttaaatagatttacatagatatacacatgggcataaacatgtatagctataaatcacagatatgtgtttatttatatatacctttgcattcagcaggtttatctttctaattagttttttaatcaacttttaattttagagtagttttagatttatggaaaagttgtgaagataatagagttcccacatacctcacacccggcttcctctcttgttaacgtcttgcattaacgtggtacgtttcatattatctttttttttttttttttttttgagacagaatcttgctctgttgcccaggctggagtgcagtggcgccatctcggctcactgcaacctccgccccccacccccacccgattcaagcaattcttctgcctcagcctcctgagtagctgggattacaggcacctgccaccaggcctggctaatttttgtatttttagtagagacgaggtttcaccatgttggccaggctggtcttgaactcctgacctcaagtaatccgcacaccttggcctcccaaagtgctaggattacaggcgtgagccaccatgcctggcccatattatcattattgactaacatccatgctttattcagatgtcctcagtttttatccagtgtcctttttctgttgcaggatcccatccagaataccacatttagttttctcatcttgttaggctttaacagtttcccagactttctttatttttgatgaccatggcaattttcagttttgtagaatgtccttaaataagcatttgtctgaagttattctcatgagtagattggagtcgtgggtttttgggaggaaggccacagaggtgaagtgctctcattacatcatattaattccatacttatcgctatagatgttaaccttagtcaccttggctgacgtaggtgttagtcaggtttctccgctcgaaagttctggttttttccctctttccatacttgactctttggaaaaagggtactctgtgcccctcccacttaaagagtggggagtttcattctacctccttgagggaggagtatctaaagaaatgatttggaatccttctacacaggagatttgtttattctcctccgtcctagttgggttttgataagggaattttttttatctgttctctgaattccaaatgctaattctgtagcacttgtattatatttgtcatttactacctagtgacatcacctacatttgtgtgtgtgtgtgataagtaaacagatttatgtcttatttacccaaggagattgtaaatttcttgaggactgggacagcatcttatttaaagccccttacagagttagatacagtgcaggcagttaataaatagtaagcaaatggtttttaaattagtttaattaaaaatttaaatattaaccatagttaactgaaacaggtcatcaaagtctaagcatatgagaaatgtggtaagataaggatactgtttacttggcatcctgatttgtgaaattgtcctgaacttgtaattgtggctaatatgatatttactgtgtgccaagcacttttgtaagtactttacatatattatttaattttccagacagccctgtaggttggtgccattatccccattttatagataaggaaactgagatgaacaaaggttgaataagttgttcaggatcacaaagccaggaagtagctcaactgggattttgatctcaaacactccggctccagagttttgaacacttaaccactgcgctctagattcattgaagtggtgattaaaatggtatctcttttgggggaaagaacaaaattgtgatttaaatatttcatttcaacctgttaggatgctcctgatgacatggcagcaatgttgctgtatttttcctagggggagtatttccataaagccacggctgtttttccttcttctgtgtgtgtgtgtgtgtatgtgtgtgtgtgtgtgtgtgtgtgtttatgagtaatttttgtgtagtgcaactaattgcatttaaaatacaggcatgttcatgattgatatgtcatatacagactatattctagatatccctcactctctagccatgtgatctgttgaaagatagtgggctttttatttcttctctggcatttttaaacagacgtgatcactaggtcttgccaaataaacactccctcagtgtgttccttgtccgaatggtcacacctgggggccccaggagggagcccagattgcagcagcaacataggcgagggaggaggacttctctcgaagccacccaagccatgaattggccctggcttcctgaaccataaacaaatgcgagctttgttctccccattcctcatttggtcccaagtatgactcagggttaggctgggtcctcaggctccgtgctgttggaaggaagtgggaggattccaggggagttctgggaccttttcaaactgaagagaggaggctggctgcatcatgggagaagaggtatttctttttttttttttttgcttttagagttgtaataaatccagttaacctgtatcttatctgtatataacattttgtagcaagactgggtaatgggtttgcattagtgggttgaaacaatgtgtgtgccagctaggatcccacagaggggagctatggataagctgaggaggaacctatcaagtatacggattatttgctaaagctgaatgtcactctggagctatttagccgttttaatccctcccactttggtcaatttggccattaatttttacagatgtttccaatctctctgtgtcttgggttttcatgtgctcatattgcagagagaaatttagatgggcagtttgcacaagcggtaactgttacaccatgtcacagagatgtttagcaattacagatgtttgtgcagtaaacaaatccagcttgcttttcaggttagcttagagagaagggtatgtccatgcagagcaagccagctgtggggcgtttcactcttgagggtcaccgacatttggagttttctttgtgagtggagcagctgtgagtagtgacttctgggtgctattgaactgctttttttatgatggggtaaagatatttggctagttttgtagtgcggggcatttataggtatgtactcatgtatggagaaaaattaagacactaaattattttgattttataaaagtttgctagaaataagtggtcttgtttttctctgtgagttgttcatatttgtctacctaaaagcagaagtctgtcattttccaaacacaaaattccctaaataaaccacaggataagtaaggcttacagtgtgtcatatgtcttccatatccctgtctctcattgaaaaaaaaattttaaggggagaattgatgaggtctgtaaaatatgtccctttatgtctttttctgttggctttaacttatactattttcaaaattacaaaaaaaaaaaaatagcgtggccaaaaggaaacacattgttttaacatatcattttaagagtaggggaacttcttgaaaggtttttaaatggcatctgttgcttgcctagaaaggaggacagaggcagatatatgaggagagtgccgttaggggttggctaggataaaaatatattcatcggcaatggcttgagaggattttcctagggaaagatagcttatgtttgctgatcttatgctggatgtctttgttctgagttctgatgagtagaaatctgaatgaggtatttatatgcaaaataaagatggtgaatcttcttccttggggaaatgagtgaaagcatgattgattgtaaggtgtgaaaaacgtgggaaagtctcagcagctagggcctggagatgggagaggaatggtagcccctggggggcctgacaggttttgccttggtcctgtgatgtctgagctacttgttgcactggtaagtgctccctgaaccctttgcttgtttgtttctcaaaatggaggtagctctgttacttctctcattacaagagctctttgtaataataataataattattattattattattattcaaagttgaagaatacaaagaaataaatagaaatcatcctcagctgagtgcagtggctaatgcttgtaatcccagcactttgggaggctgaggcagttggatcacttgaggtcaggagtttgagactagcctcggcaacatggcaaaaccccaactctacgaaaaatacaaaaattagctgggtgtggtggcatgcacacctgtagtccccagctactcgggaggctgaggtgggaggatcgcctgagcccgggaggttgaggctgcagtgagctgagatcgtgtcactgcactccagcctgggtgacagagtgacagcctgtctcaaaaaatatatatatatatatatatatatatatatatatatatattaccctcaatcctatcattcaggaacaaccatagttaacattttatatgtatccttccagacttttttttttttttttttttgagacacagtctcaccctgtcgcccaggctggctggagtgcagtgacgtaatcttggctcactgcaacctctgcctcccaggttcaagcgattctcctgcctcagcctcctgagtagctgggactacaggcgcccaccaccatgcccggctaatttttgtatttttagtagggatggggtttcaccatgttggccaggctggtctcaaactcgtgacctcagatgatccacctaccttggcctcccaaagtgctgggattacaggcataagccaccacacctgacctcttccagacttttttttgagcctgaatatgcatgcagtacacacatcactcttcactaaataatgaagtcatatcaaatgttgcctgtttttaaaaactttctatgagacccctttttctatcaggtagcctcatgatttccctcgattctcctgcctcagcctcctgagtagctgggactataggcgcccgccaccacacctggctaatttttgtatttttagtagggatgggatttcaccatgttggccaggctggtctcgaactcctgacctcagttgatccacccgccttggcctcccaaagtgctgggattacaggcatgagccaccgcacccagcctcttccagacttttttttgagcctgaatatgcatgcagtacacacatcactcttcattaaatgatgaagttatatcaaatgttgcctgtttttaaaaacttaatgtactatgggaccccttcttctgtcagatagcctcatgatatccctagggtctctgtccgttgtagagatgcagcaccatttgttgaaacaatctcccaaggataactatttaagttgctcccccatttttaacattacaaacaacattcttgtaaatccatcgttgtttcttccctgattatttccttaggctgaatttttaaaagaggaatttctaggttaaaggtcgacttaattctggctagttttgtttttaatgaaaataattcaagtatacggtaaaaaaaaaaaaaaaaaaaaaaaaaaatcccaacagaacaaaagtaagactttctgaatcctatacacttaactttacttcctggtggaaatcaccataaaagttatatgcactcttgcagatatgtggaattggttttttattgttgtaaaatatatttaacatcataaattttactgcctttgccattttatgctttgctttgttttttgagacagagtctcactctgtcacccaggctggagtgcagtggtgtgatcacagctcactgcagtcttgacctcctgggctcaagtgatcctcctgcctcagcctcccaagtagctgggagtgcagacatgagccaccatgcctagctgactttttttattccttttgtagagacagggtcttactatgttgcccccagacaggttttgaactcctagcctcaaagaattctctcacctcagccttccaaagtgctgggattacaggcatgagccactgtgcctagccaccttaaccatttttaagtgtgtagttcagtgatattaagtacattcatatatttgtgcaaccgtcatcactatccatctccagaactttttcatcttgcaaaaatgaaactccatacccattaaacaataacctcccatgcctcctacccctgaccccggcagctactgttctactttctgtctctatgaatttgactaggtacttcacatatgtggattcgtggggatatttattgtcctcttatgactgacttatttcacttaccatgatgtcttcaaagttccttcatgttgtggcacatatcagaatttctttcgtttttaaggctgagtattatttcattctatggatataatgcattttgtttatctattcatctgttgatggacatttgggttttttctatcttttggctgttgtgaataatgctacaatgtacattggcataccaatacttgtttgagtccttgctttcaattttttagatatatctccagaagtagaattgctggatcatagggcaactccgatttaaatttttgggggaactgccctactgttttctacagtggctgcattgtttcactcggtggaagtctcagcaatgcatgagagttccaatttctccatgtcctcacttgttattttctgtttgcttttttttcttcttgtagccatcctaatgggtgtgaagtggtatctcattgcaattagagttggtgttcatgttgcctgtcactgagggggaaggaaattattattattctcatcttgaaatgatgagttgggaaatagtcttagaatcaccattaactagctgatcagtcatgtaatctgaagagactacaaatcgcttaaaggaagaacacagccccactgttcccatagccccaaagaaaaaaatgagtggagtgcccaggtagttacttggtttcagaggtttaatggtgaccaggactggcttttcatgttgccccatccgcttacctgaatctatagtcaaaggtttgttggagagtagatttaaaacagttctctcgaaaaaagatgaatttatcttttgtgcaactgttattaataattctaagcgatggtatcttattcatcttacgtagtggataaagctagttttgtgattgattttttttttcctcttcaccttctactctggaattccttaggggtagaaaatgaaagtccttttttttttttttacaaattatttgctgaatcgtttatttaatgattcagttggtagcctttagtggagtgtactaaagtctaagtatttaattgtgaccctcttttgttctttacttgtattaataattgttttcataatatttatatcctgaagtatgcagatgcatttggttcctgaaatccagttttaaaaatttggccattaaaactatcatgtctttgtacgtagctgtctttttctctctgatattctcactagttgtaaaatgatattctagccaactggctttcagtgggatggaatgagtttaatgctatgtaaaaactggcaactttaaaagaagctatccagcttactttgactgcatggtggtgtgtcttttcttacacttaaagcatttagatcacagagatcagtcagtcagcagcctgttttgtacttctctgtggcattggaggccatttaaaagctacaggatgacagccttattcccagctcaggctcttaatgttggaggctagatcccaaataaatgtatagccataaatgctctagaaacaaatggaaacatcacaataagctatacttacacctctaatagatatttttctctctctctaaacccgggctataaaatgagcaattcacaaaataaaagtgtgctggaattgcctctaaaagacacttctttatcaaaaggccatcctcaagccattttacgaatgccctgtgactcagaagtgtcacctcaattaaagttatccttgaactcttaggaatcaaataggcatggtttggcaaagtgaaggcagaaagttgaggtctgtatcactcagaagttgtatttctgttttgtcatttaaaatgaggaaggtagaaatgctaaagatggatttactgcctcattttctttttcttcttttacttgctaagaattttcacccaccagtgactttaatatgttttgctccatttgttttggtaacgtctgctcagtctgttctttttattttgaattcttagttgggttctcattgtctctctctattagaagcagcttttctggaacttcttgggtaacttttctagattattcacaaagtcgataacaagaggagtagtgatgtaaaaagtgtcaatatttttagatcctagagtcgtgcaaaactgtcctcttgatgcagtgcttagcattgtctagttactacattggaagaacaagatgccttgtatattttacgtgtctaatcatatattcatcttgcctcaaacccctttactccctttacattcaggcattgttagaagctgagaaagtagacatacaatactgttgttttttcaattcagaagaggctaaaacattatgaagctggtaactctatgcccacacatggaagtaatctgcctgagcaatacctgtcacaatatcaacatgcagtagaggtgagcagaatgtaattcatggacaaccttgctgtactttccagtgaagggttataggatctgtgacattttggtattattttcgtacgcagtgcccaaaatttcaaacaactctaggtttctatgacctttagtcataggtcatctggcaggagaagagaaaagtggtctggataagagatgaaaaggggtcttgagaaaattaatgagaggctgaaagagatacagctgggtcagggagtgatcactaagtttccaagtaataaaattcattctatggggccatagagcagcagtgtgtttgtgtgtagcccaaccctgacttttccatatcagttgaagactggcagttgatcatcttggcatgaaattgagtggctagaaagaagtaagggtatcctagggcatgatgatataaggcagtgaagatggttaagaaattagaaatcaggagtggtagagaaacagtggtcgttgcagtagagagagacaagtaaacggagtccatgaggagatatattatgtaggatttgacagttgactgttctgtggtctctctggtgactgagaaagaggcgtcccattgattgattgattgagagagggtcttgctttgttgcccaggttagagggcactgacatgatcatggctcattgcagcctcctcgacctcccaggcttaagccatcttctgcctcagcctcctgtatagctgggactacaggtgtgtgtgcaccaccatgcccagctaatttttaaattttttgtggagatgagtttttgccacattgttcaagctggtcttgaactcctggcgtcaggtggtcctcttgccttggcttcccaaaatgctaggattacaggcgtgagccactgtgcccagcagggagccccatttaacttgaagcatagtgatcagattgcaaataatggagaagtagccaataatgagagtcgataaactcttcgttgtcctatggggggagtatgtggaaatcttttactgaaagtccctataaatttgggtagataaccaaccgaaacctatatgtctgaaatagataaaatgtaatatctcaggagtagggaatgtgttgtcagttccaacagtaccattcctggtctttatcttcctttgtcaccatgttccgtgaatctctattgtgttttctctgtgcggagcctatagcaggtctttgtggaaggcacaaagaaggactgctgctctccggaacttataagtggagaacattgaaatgaacattctccattgtaatagaaaaggacaaggaatttctcaagaccagaaaaatgtatcaattgggatattttactgtgcacattgtctcccctactcttcctgaaaaaacaaaatatccctcttaaaaaataacaaccacgaaaagcaccatttaagaagcacgtgattaaaataggtgatttcatgttttgtttttttaaatgagggttttcttttgcattttgtgtggcttggtgcctttgtgtgtgttacagagaaagcagaaaataatggggaaatattttagtacaggaagatgagaacatgcaaaatgaataatgaaagacttaccatttattcagataatgaggatttaatttgcctaaaactcaggcatcttaaaagataacttacaaccttaagactcctgttcctcccaagacttgctgttaaactgaagttaaaatgaatggaagaatgaatgaatatgaatgacagccaagtatagactttattgaccttttgcttcaccagaccagaatttactctacaaaaaggttcatcttaactacatttactgaatctgtccccacctcaaacttgaatcccattaaaaaaaaaaaaaaaaagtcagtcctggtttttgaagtcagcaaaatcaaagtatgttcatgttaagtggagatgcttgtcaaatagctgagaaatgaaagtatctgtgaaatctgtataattttaaaattatgatatactgaagtaaatagttctaagagtaatagagaaaaaaagtggaacctcaaaagttggggagcctggtttttatcacacttgttttttctcccatttgagaaactgtaattactttgatttgtgtttcaaaagaatttttactcatgaagaactagagaactgctagaaaactgaacaattaagctatggatcctctgcaaatagatcacagcctttaaatcaatacttcttcaaatactgggagataaggaatctataagcattatccttgagcatatatgaaaaacgttacaaagtgaagttaactctttttttcagtcccttacagatgtatgaataaggaatccatgggtttaattagaagagcaggaaatatgtttttgaggttgaaaacctttgatacaatgtctcaatactttatttggaacagcatgaattggaaattacgtcatctactagtcactgaagatattaactgtgaaaaactataagtagtaaagggtgatgataaatggcagggaatattctatatgggtggtgtctttcgaattaccgtcatgactcattttacatctgatgttcttaacatccttactaataacttggagaaggaaatataatgacacacaagcgaaagttgcatatgatttctagttgggagatgttgcaaaccaaatcagaccttatggaaagacatcaataacgtggaggggtagaacatcatttttcgctacctcagtgtatgctattttcttagaactttattttttctggccaggcgcagtggctcacacctgtaatcccagcactttgggaggccaaggcaggtcgatcacctgaggtcaggagctcaagaccagcctggccaacatggtgaaaccctgtctctactaaaaatacaaaaattagctgggcgtggtggcgcatgcctgtaatcccagctactcaggaggctgaggcaggagaattgtttgaacccgggaggcggaggttgcagtgagccgagattgcgccactgcactccagcctgggcaacagagcgaaactccatctcaaaaaaaaaaaaaaaaacaacctttattttttctgattttaaaagtaataactagtttgtagaaacattaaaagtaaaaaaaaaaaaaaaaagtaaaaagctaaaaagaactgataatttaatcaccctggggcaatcactgttaactttttaaaatatttactttcagtccttttgccatacatttttaactggttgagatcataccacacacataattttttccacacacataactttgtatcttttccacttcgcattatatagaatttcccatgtcattacaaactttttgtaaacatctctttgaaaggctgtgtgtaatgctcagttttaaggctctagatacatagaggaccagatctgggagaactggaatttggtggttgtgtagattcccatcaatattatgtttaaatctaccatgttatagctgagaacgcaacattttctttacaatataaacataaaaataccgtgggaaagcagtttgggcttgtgggctgcattctgcaaaggcttgttgaattaatgtactccctataggatctgaacaggattccagttctcccttccttactaatcttgaaagaagcctttaagagaagcctttggcaggaggcctggccaattccaggtaaaggactatgaattcaacttttcatgtctaagattctggcagctatttccactagtggctttagaaatctgtactacatgagttgatggtctcatctggcccctgtttcttaactgcatcgggaggagtatctggcctggcaatttaggatttcttcatcccttattgaatggatgccaagctttgtaaaagatggcttggggtaattttctatggtggtgtgtttgctcctgagtatcaaaagtttcaataaaaggctttctgttctctgacaacagcccatttttcccagacacatgccttgttgtttttccatcattgacagtagataagtttggatgcagccaaaagcggttggcatggacccgcacttgaggggctcctgggatggtcttccagccactcactgtaggcaccaccttaactgatgccttcttgacctgaaagctctttgttccattagctttttcctcctcagcaatgacttctgtggtgatggctgttgctttccttctctttccatttttcagttatcgctttcctcccagcatgtctgtgctgtgtaattctcttgtaaaagttgcttcttgctcataagtccccaagcggaggaatggagcagttaacctgctgtttcaaaaagttgtaatcgaaaccatcattctctgtaactagaattcataaagaagcattatgaagatggagtttttaattcagtaaaattcaataacagtaataatagctaagcacgttacctacctagaaaacctatgagatgtatattgttatgtccatttcagaagtgaaaactgaggcacagagaggttaagtagcttccacaagattgcataactgtaagtcttcttaatactaattcagtcttaccactaggtgctgaaagtggcacgggtttattcattccattcttaggtccctagtgcctagataactcattgcactcaggccttgctccataaatctaaatattttgtgatagatgttgagtttcctgttgactgaagtaaattaagaatatttagcatctcctgtgcaaggcacatgggtagatacaaagattaccagaacccagtcctcctcctccagcatttatagtccagttgattcaacaggcacatagagaagcagccgtaaatataagacagaggacagtgaatgctgttttagagattcaaagtgagttcagtaggaacatgggggaggtgagagagaattccaacagttgacatctaggatattttcgtgaaaggcatacaatatgggtttacccctcattgttgaatatgtcttactaagtggtaactggagtgtcctgagtttaatttaatctgttttgggatctccattcttgaagcacctttgaatcatctttctaaatgttttgctatacatctagaagacgtatcaaatgtggaccttggctgggtgcagcggctcatgcctgtaatcccagcactttgggaggccgaggtgggaaggtctcttgtttaagcccaggagttggtgaccagcctgggcaacatagtgagaccctgtctctagaaaaaaaaattaaaaattagctgggcatgtggccgggcacagtggctcatgcttgtaatcctagcactttgggagaccaaggcgggcggatcacctgaggtcaggagttcgagaccagcctgaccaacacggtgaaaccctgtctctactaaaaatacagaaattagccaggcgtggtggcgggcacctgtattcccagctactcaggaggctgtgacaggagaatcacctgaacccgagaggcagaggttgcagtgagctgagattgtgccattgcactccagcctgggcgatgagagtgaaactccgtctcaaaaaaaaaaaaaaaaaaaaaattagctgggcatgatggtgtgtatctgtagtctcagctacttgagaggctcgcttgagcccaggaggtcaaggctgcggtgagctatgatggcaccaccgcactccagcctgggtgacagagcaagatcctgtctcctaaaaaaaaaaagtgtaccttacctctggctgtatttaggaagctccttttttgaataagtatgtggcttgaactcattatttctaataaaaacaaaatataaaaatgatatcattggccgggtgtggtggctcacgcctgtaatcccagcgctttaggaggccgaggcaggtggatcacgaggtcaggagttcgagagcagcctgaccattatggtgaaaccccatctctactaaaaatacaaaaattagccgggcgtggtggtggatgcctgcagctactcgggaggctgaggtacgggaatcacttgaacccaggaggcagaggttgcagtgagctgagatcgcgccactgcactccatcccgggtgacaatgcaagacaccatctcaaaaaagaaagaaagaaagaaagatatcattgagcctttttaagtaacctgatgtaatgttctctgccttttttctataaaatagaggagcccagaaaatggggaaaaaaaggaataaatgttattctttgggaatctgtggagcagatgatgaaagtaaagaatgagtcctaagatactaaagtcagagctatttagtgttagcgagatttagaggtagtctttatggaagcagtaggttatctttcagagccgtagaaggagtgtttcagataagaccgaggtgaatgaacacagcaggcatccctgagatggaaagcttctggaaaaagatgggtttgttctctgactcacctcattagatactgactacacccctgattattttgtggtcgaatcttaagtatcaggatatcacagcctcatgagcaacttttttttccacccattctaatcgacattcctggccagagagaggcttacaggaaaagaagaatatgtggtaaaatatacataacataagcagcttagccgtttttaagtgtgtagttcagtggctttaaggacattcacactgctgtgcaaccatcaccaccatccatctccagaactttttttatcttgcaaaattgaaactctatacccattgagctacccgcccccacccccagcccctggcaaccaccagtctactttctgcctctaattttgactactctaggtaccttatataaaagtgaaatcatacagtatttgtcttttttgtaagtggcttatttttactttaatgtcttctaggttcatgttgcagcatgtgtcagaatttctattattattattattattattattattttagatggagtctcgctctgttgccaggctggagtgcagtggtgtgatgtcgactcactgcaacctccgcctcccgggttcaagcgattctcctgcctcagcctcccgcgtagatgggattacaggtgcatgccaccatgcccagctaaattttgtattttttgtagagacagggtttcaccatgttggccaggttggtcttgatctcttgacctcatgatccacccacctcggcctcccaaagtgctgggattacaggcgtgagccaccatgcccggccaatttccttcctttttaaggctgaataatattcgattgtatgccctaagtcttttttttttttttttcgaggcaggatcttgctctgtcacccaggctggagtgcagtggcacgatcggggctcactgcaacctcaacttcctggctcaagcgatcttcccgcctcagccctccaagtagctgggactacaggtgtgcaccaccacatccagctaaattttttggaattttttagtagagataaggtcttactgtgttgcccaggctggcctccaactcctgagcttaagcaatcctcctgcctcagcctcccaaagtgttgggattacaggcataataagccttttaagtagcagttttttggttgaaaacaaaacaacaaaacactgttgcaggcatttacctcttttctgattgaaactattttgtttcccttctctactctgaaagacagaaaagctctggaaatttctgctggggaaagaaatttcccatttttgtcttcagctcaagacatttttggagacatttgactaaactgtttactttaaatttgtcagattagaaagatgctttttcatatgtgtcaggagtttctcacatgtctatgttttttaaaatgttttagttttcaaatggtagattgattggtgttttaacaggaagctaactgttcaaaatgattacaggcccattatttttccactaaacgtttcgacactagcatcagagcactgagagacacctgcactgtgatgcttcccattagggtatattctccacgatgcctccttgagccaccatatctgtctctctgactctctaactctctaaatcggagtctgaacttagtattgttgtttgcacttgattgacacccagtaactatgtggcatgcatatatgtggacttaagggcataatagaattggaaatttttccatcatagtcaaaccaattcaccaaaactgatttatccctgtagtgactgtaaactatgaactgcctttagataggcagcctaagtatctctcaaaccttaatttcatctttaattttactgccttaggtggattattgtgtcaacctccccattgtcttcttggcttttgcatgtccttgcttttcttcttcattcctcccaataccaccagatcatctgtcttaaattcacaaatttgattgggccatgcctctacttatttttcatcactactggttgcttttaagacaaagcaaaagcaaaaactgtaacattggccctaacttaccttgctggccttttgagcccaagcagctctccagtcacctcccttcaactcccactgcgaatccctgccaccctcgatcctgtgctgggaagtccccattccctgcacacatacctgccttgcctcctgcttttcttcagctagaatacccttcccaccagtctctacttggcaaaattttacccatcctttagaatttaatgcaagttgcatcattgctgtgaggcatattttcccatgaacgtttgttaatagctctttgttttcttgttctataggtgcctttatcgtagtgcttatccctttgtattgtgatgctctgttaatgattttgtctctgctgctatattctctttttaattttagggtcgggggtacatgtgcaggtttgttacatgggtatattgcataatactggagtttgggcttctatcgaacccatcgcccaaatagtgaacatagtacccaatagatagtttttcaatccttgcccccctcccttcctccccacttttggagtcccaagtgtctattgtttccatttttatgtccatctgcacccactgtttagctccctctaataaataagaatatgtagtacttggttttctgtttccatgttaatttgcttaggatcatggcctccagctgcatccatgttgctgcaaaggacatgatttcattcttttttatggctgtgtagtatttcacgatctatatgcacctcctttctttatccaatccactgttgataagcacttgggttgattccatgactttgctattgtgaatagtgcttctgctgccaaattttgaaccctttaaagatctaggactctgcccatctcacctttgtagatacagcatctggcttagattgaggctcatggtagttctagaaaagaatgctgaatgaatgaatgaatgaatgaatgaatgaggaatgaatgaattaaggtaattgaatccaaccttcattttagaggtataaagaaaaactgaagaaaatatggctttgacctcaggtatctcttacacatagaaatgtcatgagcaagtgtgggatacatgtcagtctgtgtgtcccacacattcctgaaagctgctacttttagccaactggaccttagttgactcttaaaggtgagatgggattcaaatatattgggggaggaggtgccatctccaggtaaaggcctggattatgtcatgattgaatacgtaaaatattttggatctgaaaagatctttgtatgctagttgaattcatacagctacttcatgggaaaattaagatttagtccacatgtgtacagcatgtttcatgataaagcactggacaaataaaaccccaactggccccgtgatactcattccagccatatcatctttctctctcccttacccaccatcttaaactttcaaaatatatctaaaaggaaggcattgttaatcaaaagataaaaaactaatcctctagtaggaggaatgtttatgatttccttttatctgtcataacaacagaaaatagcattttaaacattttaaagcatgatggcaaattatgttttgccaatgtggtatatgaaatggaaatttactctggctcgttcatcctctgtgaataagatgatcctacaacaaaatagcatgcaggctcctctctcgggaacagtgggggtaaaatataaacagtgttttcatatactgtcagacgtttagagggctgccttccatgattttaatattgtctgactgtaccttctccacttcatttagcacatgagtaggttttgatcccatcttcgacactgcatttccccatcatgagaaggccctactaaatcttagaaagtcattttgcttcaacgaagagacagtctcacccctcctgttactgtcatatgcttctttccagttttttagaacatggtctctagaggtgttcaaaaagcaagcaaatgaagcaaatgatcagattttggcagaagttaaactacatgataaatgatagaatttggctcaaattctactggtatacacacagacacacatgtccctctgtgtgtgtatgtctaatatacaaatataaaacagacttcatctctatatgttcagtagaatgatagatactaaagtttttattggacagattgaaagagtaaaccctaaaagacaaataaatattgaagaatctaagatgggaccaggtgttttgtattcagagaaagtttcccattagtcttgagagttgaagagaaagatagctgttaggagacatggcaagttgcagcagcaatcagaagtaaaccctggagtttcttctgaactttgggaatttatatgaacagctgttaagaagctgtgtgtgtgtgtgtgtgtgtgtgtgtgtgtgtgtgtgtgtgtgtgtgtgtatttagacatatatatatgtgtatgtatatatatgtgtgtgtatatatatattcagacgtagtcttactctgtcacccaggctggagtgcagtggtgtgatcttggctcactgcaacctccgcctcccgggttgaagtgattctcctgcctcagcctcctgagtagctcggattacaggtgcacaacaccacgcccagctaatttttgtatttttagtagagacggggtttcaccatgttggtcaggccagtctcgacctcctgacctcatgatccgcctgcctcggcctcccaaagtgctgggattacaggcgtaagccaccgtgcctggccaagaagcattatatattctgagtgcattggtgtaggggtgtgtaagagatgatggcagaagatgattaaaaattgagtcttgtgggagatcaaatgaagaagatggaatctggggataggatctttgtctataaaattattgaaaaggctggtgtgatggctcatgcctgtaatcccggcactttgggaggccaaggcaggaggatcgcttgagcccaggaatttgagaccagcctgggcaacatagtgactttgtctctactgaaaaataaaattagccaggcagggtggtacacacctgtggtcccagccacttgggaggctgaggtgggaggatcgcttgagtccaagagtccaaggctactatagtgagcagtgattgtgccactgcactccagcctgaatcagagcaagaccctgtctcaaaaacaaacaaaaaaaaaccaacaacaacaaaaagaaaattattgaagtagtccccatgatggtaacaaggctctagactggcatcaaagaggaaggagataaatctgaaagcacagccttggtgatgggttggatatgagaaggtgcaataagaggtgaatttcaagtcatgagcctaggtgacaggataggcaagagaattttaggaagaggaggtgatgatgttcactcaactattccatagactactcattcttgtgatgtgttcatgggtgtcacaagaagtaggaattctgtagtcaggtaagtttggaatatactgagataaagttaaggataaagttaaacagtaactgaaggacttttcatagcctttaatatgctgtgatgaattgattagaccgagtattcagtctttgccaaatttatcagattatggggttaagtgttttggagattgtgtcagggagggagggtacactttggaaaatgatttcagaacaagagaatggggcgtgtgtgtgtgtacgcatacgtgggtgataatcacccatcaaagtgagagtcttttgatcataatagatatggaacttgagagaatgtgagagagcaggctaatatgaggagtatttggaagtcaggcagagagatgttcactggaaacatagctgagattagattcttctctatagcaaccaataattaataggaggataggtgatgtgtgttgggggttgaggtggggtggacaagaggaagcaaggcaagggcaaccgaggccccggaagacatcccagacaaatgtgctgtcaccagtaaccaggttggaaagagctggtacatggcagtgattgaaacagtagggctctaatctaagaggcgtagaggctctctggtttgtcaaggaggacgtctcctctctttctgcctgttgtggtaggtgctaatgctagggcaaagggtgagtgaatggtatcccactactccctgctccactcaacagacacttcaccgacctctcattttgtaaggataagagaataatgagcatttaggtcctactctcgaggtgggcactatttctgaaggaaaagggcaagaaaggtagttaaactgctaactgtgacatatttgatggattgattgattgactgactgactgactgactgactgtagagatgaggtcttgctatgttgcccacgctggtcttgaacttcctggctcaagtgatcctctcacctcagtttcccaaagtgttgggattacaggtgtgagccaatgcccccagcaagtgtgatatacttgacaactgcttctacagcagctgtgaatctgacaaggtctttaactgtgggcaaagaggtttaatatatttgaattctctaactttttgaggcaaccaaggaaataaacatcatatgaatagctctaagtcttaagcccaatttcgtaatcagaaaattactttttaaattttatttttccttataaccaagtttaaaaatagactgggaagcacacccctttggagaagttggaattggcctaacagtatgtgaggtgttacaaaggtaaaccctggtcctggaatggaattacaagtgtagttttttttcttttaccggaccatacgctttatttttagaattttgcgttgtattttactctggtgtatcttctattgatatcaaatagtttaagctgggcccaccaaatgtagatgagatgacagtttctaatgtaaatttctaagggagcagaaaagcttccggggaagcacacaaggcaccccattgtaaggacactcctttgtgctagttcttttctggctttgacttgagctggctcacagggcttctgctctgtgcctaccactcctcaccgagagccaagaagacttttcataatgccatctgtcataggtgttcatgaaggggacatgtaaaaataaatataaaaagtttacagtgagttttaatagcagtttagggatctttctgaattatggtaaacaaaaactgaaaagttacagatatggtcatatatagataactgttttgaccctcctcctgtcactgtgtcctgtagctctctgtatcccatatatgagcaggattcaggataactgtgtggaatggttgggcacccctcagcacaccattctggagaaccaaccccacaactgcagtttcagtgtttgctttgatgttcaccatcctcctgccttttttccccactttcctgcctcacactgaatgggcacttgataaatctgtactgaacagaaagggaaggaatcctctcagataccagtgttgtaaaaggaatgccatcaaagagtcatctttatcttgtgtcttagcagctgtttgaaaagtgatctcttgtgtttgactttgtgtgagtgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactgtgagtcaattaaacctctttcctttattaattacccagtctcaggcataactttactagcagcgtgagaaaggactaataaggtgagtgtttgagtactatctatggatagcttctcagaccaccatcttcttcttataatagctgccagaaagccaggcctctggacaggggagctttatcagctgctagaatgcaaggagctctctctctctctgctcccactacccattgaacctggctgcctttgtgatatgagagttgtatgtggtattcttggagaggagattttcagagattttcttctccttagcattgtcctataattggaagcttggagtttgcatgtgaattggaataaagtaggagaaggaattttatactcttgatttgagcaggatcttggtctcacgttctgcagtcacaaagaaacaaatacattagtcatttgggaactagattcccctggactccaatccagcgattgcctttcccgtaagcattagtttcttcattttggcagagaaaacaaattagttgctccactaactgaaatcatatggtggttatctgtcttgatgctgtaccactggatcttgtagcgctaggagtacatatgatactcccactgtacacgaaaatcctgaaacgtttatttagtgcttttggcaagacagcaaattggagaggtagttacattattaaatgttcaaaggaatgaactttctgaattattgatttttaaaagtcaggttttaaatggagataggtatgtggcaagaaagacaaaagttgacagcagcctggtaattaccatgtgtagaagaagatccacagtgatacagatacagctctatccatccaaccacatgcacatcctttcccagaccaagcagatctgactaatgtgggtgtgtgtactgggaagtcttcagctgcctcacagaaggaagaggaaataatgggccaagttagggagaagaacctgagagtctgttctataaagtcatatggcaaaatgggtctgtttccagatcccccgggaggtgaatgggctgtgtcctgagcatgtcaacacagccccttagtgcatggctggtgtttgtcgtggataagccaccttccttaaggcactcaggggagcaagaacactgtggaggaagccaaaggggagatcctgtatcctcttccccagccactgcaagcctaacatccctctttgttgccttctagttggaggagagatgtatggatgcgattcctgattgttctgtccacttagccctgcagtgtagctgaccttcagttatccatgagatatctgtgtactggagctagacattgcgttcatgaggcatgccctttgaaatttgggattctattcattttaagcccaattagccaaagatgttttcagaggtagagggaagctggaaggctgacgggaaagcaataattcaccaccgtttttctttgctcctgtatgtagggaagggcgggggctagaggttctcaactagggatgtttggaaaggtgtgtggtgttcagggtacatgcaatgactgggggacactatagactttgagtgggtagtggcaagggttgctaaatgtcctttaatgtgtgagccagtcttctacctgaagaaacacctcacctaaaatgccagtaaagggtaacactgagaaggagaaacaggatttgggcctctatgaaggctcatacagtcatgagagtctgcctgcttagccttctgggcagtctgtccccagagaggctagatacagccttccagttttggttcaaagccacctttctttcttcctttctttccttccttccctccctccttccctccctccttccctccttccttccttccctccttccttccttcatctttctaactttcttccttccctcctccctcttgccctccttccctccttccttccttccttccctccttctcttttcttcttcccttcctttcttcttctccttccttccctccttctccttctttccttccctctttctctttctttctgtcctcctccttccttccacctacccatcccttcagtggccaactatcctcccccatgtttccctcagcaatgttgtcacattgtctgatctactgtactcaagttcctctctgaactgagtcatttagtagcaatgacaagttcttaggccagtgagaatagagaaggcagatgtgtttggtgggaaaggagagagagaagagagggagaagagttaaaaagatgtttcataatttatctaggtatgagaataggcccctgaagttttaatccaagaaaaggcatttgattaatactaatggactccctcccacatctaggtcagtggttctcaaatgtgagcatgcatcagaatcccacggagggtgtgttcctagagactgctgggaaccatccccagagtttctgattgagaaagcctggggtggggcctgggaatttgctttactaacaagttctcaggtgctgctggtgcagggaccacacttctctaggtctgggtcctagagacaagagaaacactaggccaattcccatctccggagcactggcaggaacaggctgagatggggagaaactttgccatattctagacttttaactatggcccatgaaggagaagggaagatttaaggccagcacttcccagaagatgaggataataccagcttcaccatcacccctgtcgctgggatccatgcagaggccagtgtgctgtgttttctgaaataggaaggaaacaaaccacagtgagccttacttttttgtgtccttctgtaccaaagtaagtgcattgaattggtggccttgcttgatgtctggtagcttggaagttttggtaagccaggatatcaaagatgatgggcaatactttcttctgttactaaagaaggggaagttgtaaaaatgtgcaacctgttgaaggtctctctaaacctgttggtttaatgcccaaaccgttacatgtgtccttttttttttttttcagggaagcaaacaaagtcaggagtagggacagtgtttactattgcctttcctgaattctttgttcagtgataccagaagcactggttgtttttgttttcctcttcctaatgtgttaacaatggtgatgctttattccagccccacaaagggaaaaacaaatatgttggcagggatgctgctagaagtgtgaacaggaatgtgaatgaaatgaacactttgagagctgctatttttactatcggtacctgatttttcaaaataattctaagaacagtttttcatcaaatttgacctgatgccagaataacatcaagcttttttcatccctgatgttcccctggaatcatcaaatgttattagtttgagtacttagcggcagtttagaggtggcatattattttggtttccattttttatccaatacagaaggccctgcggcactaaataaaaatgtcaccgtgtaagacgtaaaggctttctgtcacaaatgtttttaaaaattcatgaagggctgaggatttgatttatcttatcctctttctgtgatttattcatatttaatgttgggttcaacgtttgaagcatgaataactttttcaaattaaaaactgtggtgaatcagttttttttgaagaaaaattctaccatgccagtttttgaattatgcagttcattcctcttcatgtgttcaagggccagagatgtttgattttcccagtggctggaattctcactggcaaaacccttcattgttgcaggagaggttgatttccccagctacgtggtcgtgacagctgttgccctggtatcaatagacattttccctcaggcatcaatcatgatcacacacgtgtggtagcaaaggggaagagtgggaacagacctcgccttgggaaccaatggatctgtatatttctttctatttttgagctgctgagttgcctgtgtttttaggaacatctttaggcagagataagatccagtcttctctatggacagttcataaataatgttaatagaattagccgcaaatgaaggaaaggaaatgaactcaaaacaaactcataatctttctttttttgaactagtcagtggaagcatagggtctgaggcgctggattttttctaagcccttggaggcttaaaagactataaggaaaagagctgcttggtggactcatttttgcctttgtggcaggcaggtagatctgtttagaggacatgagagtatctcccctttctctgggaggcaggtggaattctagatggctagacagagatgcaatagggtacactgtcctggacatcctgacttctgcctgcccatccacctgcctgcccgtcctgccctcctgggcctccattcctgtatcccttccttttgatttcttccctcctacttccatttttccagcctgcagtgacttttgagcatctccgttgggccagctattgtacctccatagactgagtcagcttctcataaactgaggggaactatgcctgttttctttgctaaaaatagtcaaccttttataagagtataaaggaagaaagagaataaacgctactaagtgcctacaaggataaagccctttttacctatttttctcccttgtttgtcattgaggatgaaacctattaaaggggggcagccagtatacagagcagggcataaaccaaagaatgtggctttttaaaccaatttcgagcattttgtcattatgatctggatcttattcctttgcttaatggagacaatcatcttgataagtaaaatcatctgtttttcccctcagactattgggaagaagttacctgcaactacagcaactccagactcatcaaaaacagaaatggacagcaggacaaagagtgagtttccttagttatctgtttcacatttaaaagcatttaaggatttcccaataacagaaatgttttttagaaatccctatataaccttgatagcttttgcaaacgcatcagaaaaatgtacacaattgtatttcattcaattccccaccattagggtgggcacaggttagattcagaactcctgtttttgtttttttctttccccttattacagaacgtggttctctcctgctatatgtatctcactcgtatgaagagctagggtttatccatatataacaagcactttgcacagttaaggtggctgaaagattttagagagtggcaaattaagcgctttagggattcacgagccctcaggtcggagaggcctaaccacttgaacttgaccaattttacttacccttgacttcccactggtatcttcaacacatctctgcttgaatatctccagataccactgcatgtctgcaggcaggaggctcaagtctttttggaaggattaggctaatgaatgggaggggttaactgtgttttagaacagtgctagccaatagaaatatcatgtgtgagccacatatgtaattctaaattttctagtagccatgtttaaaaaaaaaggaaaaacaattggacttaattttaatgtatttttatttaactcaatatatccaaatattatcgccacatgttatctacgtaaaattattaaatgagatactttcattgctctcttcatgtgaagtcttcacaatcccatatgtatttcataggcatagtatacctcaatttggagtagctacatttcaagcactcaatagtcatgtgtgcctagtggcaaccatattggaaagtgtagttttattttttaaaatattttctttttaaaacaatgttgtgggtacatagtaagtgtatatatttatggggtacatgagatgttttgatacaggcatgcaatgtgaaataagcacatcatggagaatggggtatctatcccctcaagcatttatccattgagttacaaacaatccagttacactctttattttaaaatgtacaattaagttattattgaccatagtcactctcttgtgctatcaaatactaggtctcattcattcttactattttttgtacccattaaccatccctcctaccccccagcccccaactacccttcccagcctctggtaactgtctgcctactccctgtggacagtatagttttagagtaattctggggtccaagaggggcttcctgggcttgaaaatgaacacagttccaaatgctcagcttgcctaagcatgtgggagaatcctggctccagcccaagccttgttcagtcctaaaagcgtctattaactacatccacatacctggccctctaggaacagcatggtgggggatgggttactcaaaagagtgggtttataggaagcccatattctaggaccagctctgttattagctagccatgtgaacttgggcaagtcattttattcctttggccttcctcttcatcatctgcattgtctgtgaagtcagagggttatactagagataaaccccagggtttatcccagcatcttcatcctctcattcagttctaaaagctttacaattcagaggggaaggtttctgcattcaaaaattaaacagctgatggaagagccaaaaggaagatgtgaacaattcagtaggaatatgagaaaggtgtctttgggtatagatgttaatatgcctgtaaatggtagcaggtcaggaaagggaattattactgtcatcaaaggcttgagggatgtttattgacagacatttttcatagacaccaggataagaatttctacagttgggctgggcacagtggttcacagctgtcgtcctagcactttaggaggctgagtgaggcaagtggatcacttgagcccaggagtttgagaccagcttcttggaaggctgacatgggaggattaccccaggaggttgaagcagcagtgattgagccaaggtcataccattgcactccagcagggtggcagagtgagaccctgtctcaaaaaaaaaaaaaaataaaaaaaaaaaaaataaaaaattcttcagtttcagcccacacacactgtctccagttgtcaagagcaaattctggggtaattgttcttccatgatttccatttagtgccaccccagacccctaagaagccccctaaaaagcccctttcatttggaccatttccctgcttcgggattttgatacgacacctatgtttaggtaacaggccacagagtaactgaacaactacatattagaaatgaccctgagcttgggatctgagcaacctccttccctcttccttctggccagaagacaaactataacaaaaattgcccagcagtgcagaagagggcagctccttcctgcgtagatgtctgtctccttagcatgctaaaatactagctcacatcagggttaagagttgtgatgattttaaaaatgttgatatgagttggtattttctgagtgaaagtgaaactcagctgatcaggatttagttaaacaacattatcatccccaccctctcaaaaaaaaaagcttttatgatattgaaattcatcagaaactcatgctggggaacagattgacataattttcataacaagaggaaaactgtctaaatattcataatgaagtgccctgaggttcctccagctcaccacatctggagtttccctctttcttattataattgatacagatttgtggcctctgtgggatagaaaaatagcccaaagggctattgaatatttttctgaaaaatagttcagtcttacagattcagaagaccagctgaacaggtgggttggggggaaaaatccttgacagaatttgtacaagggcagatcaggcttctgcataaattatgactgcaggacaaaggctgttttccctgctgaacctcatctcacttcctaactggacactcataccgcctttgcaatccctttgttcattgacttgcttcttaggagttctcatctgtgatggcaacaaatggaaccttgttgctatcattagatcattggtccctctaggttgaggctgtatcttctacttgatatccccaccatgcagcctagaaaagtgccatggattcagtgggcacataaaaagtggtggttgagcaaatggagaagtataaatgatttatgatttatcaggctgtagattgcacagttttttaaaagccgttagcaccatgcacggtggctcatgcctgtaatcctagcacttcgtgggggccgaggcgggaggatctcttgagcccaggagcttgaggccagcctggacaacacagtgagaccctgtctctacaaaaaatagaaaaaattagttgtgcatggtggcacatgcctgtggtcccagctccttgggaggctgaggcaggaggatcacttgagcccaggaggtccaaggctgtggtgagccacgaccgtgccactgcactccagtctgggtgacagagtgagaccttatctcaaaaatatatataaaaattaaaaagctattagccattggtcccctttgccaagtgtacatatacctgtatatgtaagcccctcacaatgagaccttaaacacaatggtaagaaacatctttcgaaagtatgttccaaacacctactttaagagccctctgcatggaaaacagttccattcactgtaggaaaacagcacataatgtatctcttaaaaagtatgcttagatttagctctaaaacatttatgtataaagccctcatgcacgatgagatgcaatgctagaaacatctcccaaaaacatgtttgaaacacttgcttacgaaattttatgcttggaaaacagttccattcgctatatgaaaacagcacataatgcatctctacagaagcaagtagatttagcttttaaagttgtatatggaaaccacatataatgaaacttgaaatacaatggtaaggaacatccttcaaaagtatgttcagaacaccagcttacagagctctctgctaggggaaaaaacaaaacaaaacaaaaaatcaaaacaaaatacatttgttcctgtaagacacttgagcatgttctggagtctgagtggttagcagtggttgctggtgttccttggcttgccggtgttccttggggcttgccagaccctctcttcttaccagccactgctctcccaatcggcctaagactgttaccagtggagggtgtccaggttcttggcgtcttgaacaaataattggacaaaacgcacaaacaaagcaaggaaagagtaaagcaacaaaagcagagattattgaaaatgaaagtacactccacagggtcagagcggacagcagcataggggctcaacagccaaattacagaattttctggggtttaaataccctctagaggtttcccattggttacttggtacacaccctatgtaaataatatggtggcccacagtcagtctgattggttgtggaaagcaaccaatcagaggctgaagtgaagctacaaagttacacttctatgcaaacatctgattggttgcagaaagcaactaatcagagatactttcaattttccatctgccccgcagaaaaggagcgggatttgcaaagggagtagcctatggtccttttgttacttaggtgtggaaagttgggattttccttttgatttagttctaggaagtcagcgtgaatcggccttaggttctctgcctccagaccctattctgcctcaagaccaccagggacaaggctgtagtctgacgaattcaggtttattggctcgttgtgaccagggagactgcacaccgggggacgtgtggatgttacaccaagcaaaagcaaaattaaaaaaaaaaaaaaagtcgttgcagattttgagaaggggtggaatttagtgaaatgtaaatgaaattatgttttgataggctcaaggcaaagcagggctgcacggcaaggggtcagcatcaggtcttgactgtgaggtggactcaggtcctgtttctttggcagctaccaagtgaagatagatgtgtagtgctgtgtccagaaacccgttacatgaggcgctgcacttgggctggaaatgaagactgcttctctgggtcaagtggcttagcgccttcaggccagagtggactgtttcattcttcctgatataatttttttaaaaaccaagtttctggtagtttgtctctaaaatcacatactttgtcagggagtgagaaagtaggagcactccaagaagagggttgttaaggacactttgcaactactgcatatgcttgggagagaaacactgtttcctgatcactttgcaggtggccttatctgtgtctgttgccccagcctcaagaatggctgggcagattgctacttactcagtgcagctcatttttgctttctcaccacatgtttaaataggaaaaaaaaaaaaaaaaaaaagagtcaactctcttgtgttgggttttcctcagcttcataatatatacccaggaactctgatcctattttttcagactcagtggttttgctcacatatcctcccccaaactcactcattcttgggcctggggatttgggcacatccaatttgctgcagcatgtctcatattcacccctttagtgcctcccatgcctgtcatgtactgaagcccctcatgcttgatgtcccaggggtacccacctcttcctaagaagcacctttcatcacttgctccccaatacagacattgctgtctggattcagagtgggagccttcccaggagggtgcccagcctacccgtgtggcttaagatctgcatttcaaatacagtcctcttgagaaaaaggttaactccctttgtgttttcctggtaggttttctttctcccaaagactctccaaggagcttctcatctgagcttctcatctgaaagtaccatcgagaggagcagtgatccagcctctgctgcattgtagagacaagaagggctttgcttgtcagattttcatttcttctttttaaaatatacttctctttttagaggaggttaaatggtgtcataattcatacttgtgaaataatttgaaagtcaaattcccaacagcatccgagaccgaaggtggttgtttggagttatggtcagcttcttcataaaggaagacactgggttggcgttgacagacatactgacggacacatcgtgtttcatttctccgtctcaatttaaatgtagaccatggcttcttcacctcagcagtattgacatttgggctggatcattgtctgttggtgggcgttgtcctctgtgtgcattgtagaatgtttggcagcatccctggcctctgcccactagatgccagtagcactcaacccccattccctgccaagttctaataagtagaattgtctccaggtattgccagtatttcctgggaagccctagtttcaaactgctggtatagactgtagtaagccccacgagggcattgtggcatccctgctgcctggcatgcagtggacgctcagttattatttactgaatagatgacaagcctagtatgtatttcactactcctcactagccccagatcctcagaatctgacccagaactggagttcctgtctaaatctagcatatggcacacccacccccagtgctaccaccatacttgtccaccctccaggtccccacaactgttttgctccttcctggaattaaacatttgctaatacccattactagaccagtggttctcacagcgtggtcccagaactagcagcagcaggagcatcacctaggaacttgttagaaatgcaaataccagccctacagaatcagaacccctgggggtggggcccagttgatctatttttacaagctctccacctgatgccaatgcccactcaagcctgagaaccactgacctagactaaggccttttttttttttttttttttgagacggagtctgctctttcgcccaggctggactgcagtggcgcgatcttggctcactgcaagctccgcctcctgggttcacaccattctcctgcctcagcctccctagtagctgggactacagacgcccgccaccgtgcccggctaattttttgtatttttagtggagacggggtttcaccgtgttagccaggatggtctcgatctcctgacctcatgatccgcctgcctcggcctcccaaagtgctgggattacaggtgtgagccaccgcacccggccttttgtttttttttgtttgtttgtttgtttttttttgttttgttttgttttggagatggaattttgctgtgtcgcctaggctggagtgcagtggtgcaatctcggctcattgcaacctctgcctccctggtttaagcaattctcctgccttagcctccagagtagctgggactataggcactcaccaccaagcctggctaatttttgtatttttagtagagatggggtttcactatgttgaccaagctggtctcgagctcctgacctcgtgatctgcctgcctcggcctcccaaagtgctgggattacagacgtgagccaccgcgcccggccagactaaggtttttaaagcttctctgatgatgagaatcaccagagtatgtgtttagtaaatggattcccggtcccacctcagatctgaagattcacatctgcagggaagaggtctgggaagataatagaatgaacaggtgccccacaaaattcttatcagggatgattgattgggaaacataccccaatcctactcctctggtcagtgtcctagaacattgtacaaagcccactgtcattttcttcctctctgacaagatcctgagtctcttgtttgggaagtgattgtcccgtttcagatactctgacactttaagccgaatgcatggctctcatcctatcttcactgttgtctggtcaacactgtatgtttgcaaacccttttctgctacttgagctcctcgagcagatagtgtcttatttaccttaatttctctttcctagaacatgatagaagtccacacccttatgtgccattctaaaatacaaaaagctctgaaaactaaaatgttttattactcattgggtgataaaacttgttctggactgacatatgcctactcatagtctttatttttcccacttggagtgaccagtcatccatttactgcagaattttaatggttgggtgcagccccagcccccagctgaggatgttacgtattatatggtatatgcagtatatttcctttctaaaatctgaataatcctgtccccagggcttctgagtgagggattaccaaccagtagtgtctgagataatatttgtcagttgaacgagagaatttctgattatgatgtgcgtgaaactagattatccctgagcttgatacttttgttgtactgtcccaagggaaaggaaaactccagttttaggtgtgacctggtactttccaaatgctgcttaaagctctgaaagtcttcctagcagaatctgcctatgacacatggggttttgatctttataccctaaaactgaactcagagagttgtcctggatttaatgttatttccttctgtgtatatgttcagcttgctgatatatttattctgttggttctgcttttatttttttttaagctgagagggtttttgcttgtttgtttgaagttggtttgtttttattgaatagattataaaactagctgcaggcagtcatgtgatgtgggcatgtgagttcaattcctttaacagtctgtttttaatattatgtaaatttctaaaagtttagagattgaaataatgttttttggggagggtgtaaatcatgactggacattttggtgattttaatagagcaagcttcttaaaatttgaaagccaataattagtactggggctcttgatgtgggaactaggtaactaacagctttggggtcctcaaaccttctgatattgtatacattttctctgcacatttgagtgtgtgtgtgtatggtttgttgtgttgtgtttttttttttctggaaagagtcattgctttttatcagattcttaaaggactctaagacaaaaaaaggcttatgaactgatttaggatttcagtcttatgctaattcattagtcatttttaacctttctaaagaaaaaagacaaaatcatctcaaattgctggataaattatgctttattttttctctctctctctctctctatgtgtgtgtgtctattcattcctatttgatctctaattaaatccatccaattgatgaatagatggaaaatgcctgcctctcaaaattaatttaattcccttcttctccaactctgtccgatactcatttaaaatttataatcttcccacatccaaaggatgtggaattatacccttcttttaagacatatcaaatgcctcctcttttgagaactttctcctgaatgtaatcttgcctttctctgaaacacaacaatattccatcatagtgagtttatgtgtatgcatggctttgtcttttctttctgccattctcctccccttgcttttctccaagaattagactgtcacttccatgcagggacaggagggggtggttgggcttacttgtatattacagtcccccaaattggcaatgtctttttcatggtggtggtccaataaatatttaagtggaagtcaggaacatctttgttccatatactttaacattaaaaccacaaactcagagttaataatttttttgcagataacaattttgagtgtcttaaagccactgatacatccaatgcaacgtagtattttttttctttcttctaaaaaaaaaaaaacgggatacacgtgcagaatgtgcaggtttgttacacaggtatatgtgtgccatggtggtttgctgcacctgttgacccatcctctaagttccctcccctcatcccccaccccccaacaggccctggtatgtgttgttcccctctctgtgtccatgtattctcaatgttcaactcccacttatgagtgagaacatgcggtgcttggttttctgtccctgtgtcagtctgctgaggatgatggcttccagcttcatccatgtccctgcaaaggacatgatctcattcctttttatggctgcatagtattccatggtgtatatgtaccacattttctttatccagaaatatttttattttctaatactactgaattcaggctcaaatgcctcatcaataaaaatacattcctgttttaaaatatgtcataataaattaaagtgtgtgaagctaatggttgccgggtttggtcaggagttctgggtgatagtgcctgtgactagagtcatgaaaagtcacagctcaaagtcagagctcccaggaactcaggtctagcccagtgtgccccttggagccctcagagcttcactgacatgtctttggggacctgggtgggagatgggacagccctactccccaaccagaacagctctttttcagttcctttatatttgagctctggaataccttgaaatttgctaagtgtcctgctgaagttaaccagactctcctctctcccctccttagctggtccctgattttacacctgaggacactgaggtcatccagagttgtagtgtgattgtctcaggtcatgtgcttgcgaaagcccagctgggaacccaacctagtcccaagtatcctgccttctggcccaccgtcctctcctcctcctccttgtggcccctccaagtgttcctccactttataggggtcacttggagatcatcaagaaacattgagtgggagctctgtgtccggttttggggggtgcaaagagggctgagatatgctgcagcaagccctggcaccaggatctcctctttttctctaacagtggtgctttccagataattctgtgtctaatgccttacacataaaacagcatagctgcacagtcgaagtgttctaaagctggattatggtgatggttacacaactgtataaatttattaaaactcatcaaattatcactgattttcttggcattcctcttgcagttgaaatatgatttcaagagcaccaaacactgtactgacgtccaacaaagataaaactgttaaaaggagaatggcaggggcaactgtcttcctcaagtctgcctgtctgtctctctgtgtctgtctgtctctctctctctgtctctccatgtctctctctctctgtgtctctctgtgtctctcggtctctccgtctctctctctttctttccctctgtcacacacacacacacacacacacacacacacacacacacacacacacacacacacacacacacaccagggaacaaaatctaacagcctctcccacccccagcagatttcctctcacatctcattggctgcaaatagagcacctgcccatccctaaaccagtcaccaacaaaagagagtgagattaacattatttgcctggacatattttgctttatccccagggctgtgagagggttccatgttcctgaatgtaatgcctgaacaaattaggattctgtgaactaggaagagggtggggaatgtctgctgggatgttaaccaacagtctctattacacttaattaactttttttgactgaagggaacagaaacatgacctgttctttctttgttggctgtgggtttctgtattctttgtaaaaattgtttcatgatttccatccaaataattattcttaaagccaggactctgtagtgcagttcttcagtgatactgtgtttgtgttgttgtaagttttgagattggcagtcatatttcactagcacagtcaataggaaaattggtgaggagctgtcattatccaatttaaacatgttttaactttttctgtctctgtagaacatttgaccaattcagatttggggaggtttgctattactaagtaaagagagatagaacgttggtaactatatgggtttaggaatatggtattgatggaatttagaactattgcccctcagcacaggttaaggggcaaaagccatcagaggcccagaatacccaagatggaagatttccaacactaggacagggaatgtaactaatattttcaagctattgtaacagaatatgaaaacatctgcacaaaagcaaagtgaataccgcctctcctcccttcactccttccccttccccttcctccctctcttctctgtcctatcccaaccctagaccatagtgtatctgtattatggatttcttaattgcttttattttatatgtcacaatctctggttgttgggatgttaaccaaaataaataaacacatttcagtaatataaattacactagggacagtataattgtcatcaagaggttacctctaagacatagctctaggttgtgatccgtctgcaggaacgggcctgatgcttgggaaatatctaaggccattcacagccattaggtttgttgactttgatgcagaataatcgatgcctgtcccagtagatactaattctcttgaatttttctgtccaccttctgtcctgaatcatcaaggcctagttttccaagtctccatttccgaaatacaaatgttttcactatcttcgtaacttgtgctttcagataaatagagatgatttaacagcacatggactttcaaaagcatgtaattcaggacatacttaaatcgatttttagtggccttagtatttttccctctttggtgagggctattgcatctctttgctgaggaacagccatctatgcatagggaggttcccacagaaaggccatgggacatatttgaacaagcttacccccacacatatgtgtgtaaagaatgttcagtcaatacttgttggctgtttatggttggcatgtgcttacatagaaatacattgacatttgtctcttaagacgtaccataatggggtaacttttcattgttttatgtatcctgggtagctttgtaacatgtataaataccttgtttctaatttagtaatgtgtgggaaaaggcagtgaggcaaaacttaaggtttttttgccctctgtagactatatatgtttatgcatgcacctgaagagtatataaaatggtatatgtctgttttcctgagtaaggaaacctttttacctttctgccagagaaaagcaaagcagtcaggggcatctcatgatgtcacatgatttgtaaggggaaaaaaagtggaagccaataaatatacatgagccaaaaatgagcactctcgggtcattttctgagggtcaccctttcttcatgcagcagtaatatgctacctgttaagtgtgcctttccctgaacttaatgtgatagagatcattttctcctgggccagctcattagataaagcattttaaaggttatgttttctgtttttcttataggcaaggattactgcaaagtaatatttccatatgaggcacagaatgatgatgaattgacaatcaaagaaggagatatagtcactctcatcaataaggtaaacaaaggttgtctcctaccttctaaatcgcgaactgctttggggtgttgactggacagtataagcttttgcttcagcgcttgaaagcttggttttctcagtcctgaacttgtgaggaagaatcttgtatctttccttttgatcaagctaagcccagcatccaagtgaatgcattcgttgagacgagaatagatttgtttgccttaggaccagctgcagatttgcatggtccttcagaaaagtctgttccagaaggaataacccaaaaggcagcctgctcggctggagatcctgccctccacagcagccaggctgcagagctctgtgtcctgaggtatccgaggaggagtttttttttaaaacgctggtcatgcctcacaggcagaaaacgcttaaagaatgtttgctgttcagatcaaagacaggtagagtgcctgagagaatttttcctgtctcgtttgggctaagaagattgaatgattttattattattagagccagagccctgtaaataaacagagagctataaaatctgtgtgaagtgatgcaattgaacaagggccttggctgtgtactttgtgtgctttcacacaatggtactcaccaagtaggtggttgaaagatatattatttaagcaatacccagaatatatgactttttctctgaagaacagcatttttgtgatggtcaaatatggtaagaagctgaatggtcttgaagatgtgtatggtggttttattcttgtattcaggggagtgacagggaacttagcacagttcccttagcacaagtgtgacttgggagatcatcgtggctgcctgcgctcgctctcgcagggctgggaagccttggcagggtggaggatgcagggaaggggaagagattgcaggtgcatagagtgggagtaggcccagggtcccgccgactgtggccattactgagagggtggagactgtggtgtcacctggccctacccctcccccagggcttgtccataaggtgatcagtaagatttgcctttgttatcaagaggttacctctaagacatggctttagagattgtgtgttttaagagccaaatccaaacatgtcagggaactaatgacccaagaagttaactagcttgccacaggtcaggagttttagggagaaagctggtcctctcatggactccatataacagtggtatggagtatataatgctttctggaacagcaaatcattccctgttttgcagatcacccaagaactcgtccatctttttacctgtaaagtattctcccctgaagttatttcagtatgtctctgtaggtgttgaacatggcaggaggaaatgaggggaagaatgcttcccttgttgttttctgcaaatgaggcagaagtgattcttttctgtctctttcagattgctttctgacacacagtgcatttcctatttttaatcagacctgtaaccaaacaagcggaataaggaagttgttaaatgggtgtgaagcacaatacgaatgctgtaataattagcacagataatttggttttagaaatactgggaaagggctagagtgcttttttcccccttgatgataaagcaaccagagaattaaataactgctattctttgcagtgggagggagcgggggactcactagcctgtttttgttttgtctttggaagagagggagcctctttttagttgaaaacctggtatgtcaataatatttaatgaggtctgagaaaagacacacatctgtttctattttgacatattatactccagtccttccatttgaatacatatcataatgagaacacattcatcttgatgattttgttcctaacctcccagcctgagatccagtctgataaaaattaatgtgatttttctaatgaccttagtcagaaagggagtatctatcggtcccatccacatggtacagataaatgaacaggtagatgtggcaagctgctttcaagagtgttgtgaaggttacatcccatttctctggtttcatagattaacgtatttgaaagcaatttagaaactgaagcagcgcactgctattaatattatatttgcaaaacatgacgttgtcatctctgctgtacacttggtctgttgacctgactttcacattgatccaactcctcaggcctagagttctcatatcaccattttgacacttggtcctcctagtcccaccctgctcccacccacaagcctttctctatccctgccacttcctgccctgcagagctaagcacaggcttgagttgttctgtatctgtccaggccaggtgagcaaggaccaggcttcctccatccttctttctctatcacccaccatagcacccggtctggaggagagccctggggtagtgaaggatggagggatgtttccccccactccagtgtcccctacccacttcatccctagcacctcagccccttctttttgtcattctctaacactgctgtgctcacttacccttctgcaccaatcaaaatctttagtaactttctttttctttattgtaaaatccagatagatgatcctagcactccttcacccgtcctgacctcagtctgtcttggtggccttggtccatgtggctgttctgcaggtaccccccgtatatccccctcctgcttatgtgtcctcactaacttgactcagaccatgttcctgatgcccgagatgccctctgcctacccacattgctattttttgtttgttttgctttattttgtttttgagacagggtctcactctgtcgcccaggctggagtgcaatcgtgtgatctcggctcactgcaacttccacctcccaggttcgtgcgattctcccacctcagcctcctgagtagctgggattacaggtgtgtgcctgtacagtaaatcatgcctggctaatttttgtatttctagtagagacggggttttaccatgttgctcaggctggtcttgaactcctgacctcaagtgatccacgcgcctcagcctcccaaagtgctgtgattacaggcgtgagccactgcagccggcctagccactgcacccggcttccagtttgctgggtttttttggatagctaatcacacagccagtcttaactcatgctgcttgggcccattttagagcttgctgcttaagaaaatcctttgtgctctatcattttgcttttattatttttttatacaacctgctgggaaatcaaatctcttgctatcctgtgcttgtgcagatttttacttttatttccataaaatgcctgccagccttaacctagcattccagtttgccggaagcggtgtgttcagatgacaagtgccatgtaggctaccagctcccagaaccagggtttgaatcccagctccactgttcctggctgtgtcttttcgggcatgttgcttaccccctctgagtctgagtttcctcagccataaagcaagggccataaagctgacctcacagggctgctgcgaggatttactctggcagggaggagtctgtcagtggcacccataattctaggaattgtcacccaaccctggctgctctttcttgggccctggaagtgggaatggaagggctgttgtgtctgagcccagtttgctgctgaggctggaatgccatgacgttaagtaggttaaaatggtgaaaaatccacctaaaatagttaagtgttcacagtggaggagattttagcaagaatttggaaagaaaacatgccataaatattttgcttgctgaaagtgggaagaatggagtcggagcctgtaaaaccctgctgacattatagaagattgttactcttcctctaagttaggaatcgcccagaagttcattgagatgattgtatactattgctattataaaatgaatggtttcaccatgatctgtttaatatgcattctgatacgcatatttattggatgtaggagttgaggtgaaagacctgaactgctgttctctaaattctgtgttcgccgtagaggttcctgatagaccccgaattcctctgacatttactttggtatcattgaaggtggtttccctttgccctgcttttctgtgctgtagcaggagtcacagagcaggctttgccctcatttttagccccagattgtcagttcatgtggctttctagaaaatgagtcagacacctttagtgggtgtgtataagccctctgcagttcctgaaataatgtgcaaagacccaaactatttctgtatgtccctggaagccaggaggaaatgtggcaacctgaatggtttgttttctagtttatttataaagaattcttgtgaatttaggaacatttccactcgtgcagaacacacctgtgtttagcttttatttccagtcactcaaaaataactcccgtgtctgtgttcctgccacccccatccctgccttcctgatttgtgctcagagtgtgtttgaaaaggttccgaagcttctgggtctcatcccaactggagaagcttcctggagaagggctgagggcagcttggcaggagctatgccagggctcagctgcaagggtgagatggccattggaaggtgtcccacgctgtggccgctgccgcttggggcagaatgagcccagctgtggagagtggccatgttcccactcttggccaacagcctcctggcctcagagcaacagccattcctcacagctcccactaacctaggaggaaaggcttcctctgtgaccctattgtaaacaaggacctttaggtgtttcttatcaaacaggcttccttgggtagttgtgtctttgacccttaagcatacccaacctccctgtcttcattgttttaagcctatttgatgacatcaagatgaacgcttagaaagctaacgttattggtcaaaatcgtggagtcgtagagatggagggaagggaacggaagcaatattagctagcattaatgttcatggaaggaaactgatagacacaccctagagaaagaggggacccaggccgggctcagtggctcccgtctctaatcctagcagtttgagtggctgagacgggaggatcacttgagcctgggagtttgagaccagcctgaacaacatggtgaaaccccatcttcaccaaaaaatacaaaaattagccaggtgtggtgttgtgttcctatagttccagctacttgggaggctgaggcgggagggttgcctgagcccaggaggttgaggctgcagtgagccataattgtgccactgcactcaggcctaggggacagagtgagaccctgtcccccaaaccacaaaaaagaggggacccagaatattagctaaagacggttagtggcatccccaacacagtagtacagtcatctttccttggaccatgaggattatccactgaagattattgacaacaattttaatttgcaccctgtcctcttcccctcacaatgttcgttcactcattcattcattcattcattcattcattcatacatcgaagaatatttatggtgtgccaggagctgtgcaaaatgctggaatacaatggtaagccaaaaattcaaaccaggaattttgcttctttgtagggaccccaagtatttggagctagacatgctgtgagggcacagttagaaccgctccttttcatctctacctcaatatgttttcctccctcctgtcccagacaacagttgaacatttaattaacttaatgatagctagatctttctccaggaccacagcttcccagcacaggattctgaaccactggcagcaagagcccgggaccatcatcaccattcccctttcctcaggagtctccccggagctcagcatttcccctcatcttcacagcaaccccgggaattaggtgggaccatgcgtgttctctgcagattacaaaggaggagcagaggcccagagtgctgaagcagctttcccgagggactcccagcaagtcagtggcagagccaggtcagaggcatctgctgaccctgggccaagtgctcttggaacttgggggctgggcaaggtggtaactgcgggtggagttcgtgtttcctgtggggctgagtcacttccagaggtgactcttgtctactcattgagagtcctcattgttactggatatccagggcaagtgtctgtggagtttcctttgtaaggtaatgacattatcattgttacttagcagaaaaacagtattaccatgccatcaccccatcctttgttgctgatgctcgcgttttgaaatctatgtttccgatctgttagggtcaggacatcactgtggtggtttctggatcatccatgactgtaggagtccactgccacctctaaaagagtgaaatgatggtccatgcagagggaatgatgagttcagctcagggttgacattggttctttttgtgcctgaggcctgcctccccaactgctttcttccagtttcttcccatgcccagagtattttgccttcctcttttcttcctagcctggttgccacttagctttccactcgctgtcggggggcaaaaaaaaatgcaggcgggagtcctgaggcccttcctaagacattctgtgatcaactctgttattttttttgttctaatgtttatttccccttcctgcctccctcccattaattcattaatgaactaaaacatgtattcatgagaaaaatgttttcagacttccttgcttcccaccccacaggaaaataaggttgccttcacaaagagaagcagcctcaggaatctcaagcaagatccttagcttggcaggaagaaagccgatcagctaaatcgattgctggccctgaccctttctctctgaactgctgaagcttttagcagagctcaaatggtaggattaaatgtggttccaagggtgaggagtaaattagcacgtgtcaccctgaagatgatgacatgctgacagacccattagacagacatgttttatgagtgaatgaagaagttaagcataggtctgggatcatctgggtttacagacatttggaaaatgtcagtgttgagcaaatgagtcattgatgtcatagaatgtatttcttgcagcatggcctatcttgttagactgcttatgtccttattctagacaaaagtcacaatatatctcctcctcagagcatttaaaacccaaaggagtataatttgttgctgttttgtcttccttttataagtagccaggacactgggaccagtgagaagaatcattaccatcacacagacatagttttaaattacatgaggatggtaaacatagggcttggggtgggagaaaatatcgttttagttcaccagtagacagttgttgaaaggccaccccaacattttgatggtcgttattatagatttttcctttgtatcatggacagatgagcttgcagctgatgtaaattcccaggtgcatatgcctacacaaattatataaaactgtctaaagagatcctgtgtttgttcaacctaattgtcatatctctgcagaatgttgtgctaaagtggcaggacatcagtaatcccccatcttggaatacttttttttcccctctgcaacacacagaaaaaaaaaatctgtaggtatcttaaggaattagagaaactccccttttttttctgtttctatctccaccctttctatttgtattactctgttaggggtgttctgaggcttaaatgacatgttgtattcaaaagtgctttggaaacataaaggttaaatcacagggctgggtgtagtggctcacacctgtaatcccaacactttggggaggctgaggtagaaggattgcttgagccaaggagtttgagaccagcttgggcaacatagcgagagactctgtctttacacacacaatattttctttaaaggttaaatcatagttattgctatgataagttattagaagaagatgaaaagacaaatgcctggtaactgaatgttctttcctggtatattgaactgtcctgaaattaaggtcagtacttcccctgaagttccttttcattatttattttagcttttcttaggatgaaagtaatgtattacagttgtgtaacctgtcttgttcagtatctcagagtgctttgcattcatatttgcattttattaaaatacacggtttctgagatgaaagtggcatgggatatacttttttgtttgtttgttttttgagatggagtctcgctctgtcacccaggctggagtgcaatggcgtgatcttggctcactgcaacctccgcctgccgggttcaagtgattctcccgcctcagcctccgagtagctgggattacaggcaactgccatcatgcctggctaatttttgtatttttgtagagacggggtttcaccatgttggccaggctggtcttgaactcctgacctcgggtgatccgcccgcctgggcctcccaaagtgctgggattacaggcatcagccaccacgcctggcggggatacacttttaagtcatactttaaaattgtataaataacacttactcttggaaaaaaaatgagaaaaacagacaaataaatacaaagaaaaatcaaaattaccggtgaccttaccaccttcacatacctcttaatattttcgcaattattctttcagactttttccatatgtgcacataattacagtttaaaataaaaataggatcatattacatacactattttataataaccctctttgtccaaaatacatcatgattatccttggcagcatgggtaaatgattccttagcatcctgaatcctaatgtatggagagagtaccaaaatcctctttttttttttttttttttttttttgagtcagagtgtcactcttttgcccaggcttgagtgcagtggcatgatctcggctcactgccacctctgcctcctgggttcaagcgattctcgtgcctcagcctactgatgagctgggactacaggcctgtgccaccacacccagctaatttttgtatttttagtagagatggggtttcgccatgttggccaggctggtcttgaactcctgacctcaagtgatccgcctgccttggcctcccaaagtgctgggattacaggcgtgagccactcggcctggccctcgacaatcctcttttatgcttagcttgtttccagtttttctttgtgttagaccatgttgcacatagtcgtcaccctgttcaacagtctttgtgtgcatttctgccacttccttctagctgtgataccttggcaggttactcatctctgtgtgcatcagttttcacatctgtgaaatgagagtaataatagtacctacatcctggtgttgtgaagattaaatgagatgaagtaggtaaagcatttagaaagcctgggtcctaatagctgctacataaatgttagcagttactatttcctgatgataaattgctcagtgtaatactgtattgatgcattttgagggcatattgaggatacatcctgaaagattgtgccaatttagtctcctcacaggagtgcatgcaaatatatttccctattcttgtcatccctggatattatcattctttttaatctctgctaatgtgatttgggctctgctaattctgcattttaaaaaatgattaccgagcttgaacattttatgcatcatttccaattgatttttataaaaataccttatattcatgacattaacctgtcatcttcatattacaaatattttttcttagtttatgactcatggagatctttaagaaaaaaagtcattaaaataagtgccttttaggcttaaaatttcctcattttatagttaactgtatagtgcagtaaaatgtgtccttttaaaaatagttttgattaaggtttttatattttatttctagctggaaatggtagccaactattaaatgcattctttttctgccttcctcagggctttcagtgtttttatttaaagcttctgtctttacagtattttttttatagtggcattgagagagtccctgaggttctgcatggatgcgtataaggatcctcatatcctagaacagggtttggcaaacttctgcagagggccagggagtaaatatttcaggctttgtgggtcatgcagtctgtgtcacaattactcaactctgccattttagagcaaaagcagccatagaggtaaatgaatgggtgtagcagagttccaatgaaactttatttatggatacttagatttgaatgtcatataattttcacatttcttgaaatattcttcttcttttgatttttaaaaaccattcaaaaatgtaaaaactattcttagtttgtggaccatagagaaataggtggcaggctagacctggcccatgggctgtagtttgctggcccttgaaatagaatatctggaaatagactcataaaaaaatccagccgattaattttcaacaaagatacaaagacagtttaagagaggataatcttttcaagaaatggtgttggcgaccgggcatggtggctcacgcctgtaatcccagcactttgggaagccaagacgggcggatcacgaggtcaggagatcgagaccatcctggctaacatggtgaaaccccgtctccactaaaaatacaaaaaaaaaaaaaaaaaaaaattagccaggtgtggtggcgggcacctgtagtcccagctactaggaaggctgaggcaggagaatggcgtgaacccagaaggcggagcttgcagtgagccaagatcgcgccactgcactccagcctgggcaacagagcaagattccgtctcaaaaaaaaaaaaaaaaaaagaaagaaaagaaatggtattggcacaattggacacccataggcagaaaaaaaaaaaaaaaaccaacctgaacctattatacaaatttaactcaaaatggaccatagatctacatgtaaaacataaaacatcaaaagttatgtatgaaacactggagaaaagagttgttagacatgataccaaaaacacaatccataaaagaaaaaacttgccaaattgaacttcagcaaaattaaaaacttttgctctgcaaagacactcttgagagaatgttattggctagtctatttttcctacaaggccatctaagccccagtgttcagtaagtaattgcctgctacgtaattgcgtggatttgaaggaccttggtttcattctgagtcttcctgggaatacctcttgtaattcatggatctttcacattggagcctttccttgccccgtgccctttctcccctgtggtggcagacagacagagccatactccagtggtctgttctggactcagctgagcagcccgagggcctggatttgactttggaattgtattttttactcgctgcacaggcctagaagctaaatcagctaagtatagattaaaagccaccaaacaagttttcaggctaagaaatatgttttcctagtagaagaatttcttaaaagaagtgtggatttgtctggtgaagaatggaagtggaagataggaatttactaatagtcgctgcagctggcttcaatgttcttgaccttcaaaatgatcatgtctatgcccttcacctcctgttccttcccagtccttatctgtggaatgaagaataccaccttctccttttttaaagctttctttgtatctcttagaattggtgcaggagctaagaaaatctcttaaaacataataataaaaaatgctttatgaacgctactgtctacctgtgaagcaaaatgattttctctcatagctaccatccttttaatggaagaaaagcatgtatttggatgcagagtcaatgcagttctctaaaccataaatgaaggtaaaaactcagctataggatgctcatcctggaggagtagactatatattcagcaatgtgctatggatgagctgaaggtgccattagaaacagcttttaagatttccgattaagcggtcatctcaatgtaaatgacctagcaaggtccctagcaactttcccacaaaatgagaagtttctgtgaaaatgttgttacataagtttacattcttgattatatctatttatatttttttaattgtatttatttattttttttgagacaaagtctcactctgtcgcccaggctggagtacagtggcaccatctcggctcactgcaacttctgcctcctgggttcaagtgattctcatgcctcagcttttcaaatagctgggattataggcatgcgccaccacacccggctaatttttgtatttttagtggagctggggtttatgttggccaggctagtctcaaactcctgagctcaagtgatctgcccaccttggcctcccaaggtgttgggatttcaggtgtgagccactgcacccaaccacatacttgattatatttaaatggacaggaaaaaaatgtaaaagtgctagcttaataatttggattttgtgtatgacttgttcacatgcccttatatatagttaacgtctcttggaatacttaaagccatcttacgaggacattgggaaggtcctgtctatataaggatctccttttcacatgattactgttttttggtttttgttttgtttcgttttgttttgttttgagacagagtctggctctgttgcccaggctggagtgcagtggcacgatcttggcttactgcaatctccgcctcctgggttcaagcaattctcctgcctcggcctcccgagtagctgggattacaggtgcccgctaccacatccagataatttttgtatttttagtagggatggggttttgccatgttggccaggctggtctcaaactcctgacctcaggtgatctgccctcctcggcctcccaaagtgctgggattacaggcgtgagtcaccgctcctgcccgattttttttttttttgttcgttttttaagacagggtctcactcttgtcacccaggctggagtgtggtggtgtgatcgcagctcactgcagccttgaccttctgggctcaggtgatcctcctacctcagcttcccaagtaggtgggactacaggcataccaccacatctggctaattttttgtagagatggggttttgccatgttgtccaggttggtctcaaactcctagactcaagtgatccgctcacctcagcctcccaaagtgctgggattacaggcgtgaaccactgcacccggccaattactgacccttgaagtggacttatgggagtagaaattctttcattccacaattagaaaaaaggctaaagcataaacattttttagaagactttagattgcatatgttgcaaaggaaattatgaaatcaataaataattctggtatttttttgtatacaaactatatagccatgttccacaactctaggaagtaccaaatatgaatggtcaccctggagttgggccagcatggcagcatctgttgggtgctgttctctgaagaggctccagatagaaactgtttttttttttttttttttttttttgagacagagtctcgcagtctgtcacccaggctggagtacagtggcaaaatctcggctcactgcaacctccacctcctgggttcaagcgattctcctacctcagccttctgagtagctgggattacatgtgtgtgccaccacgcccggctaatttttgtatttttagtagagacggggattcaccatgttggtcaggctggtcatgaactcctgaccttgtgatccacccaccttggcctcccaaagtgcttagattacagacgtgagccactgcgcctagccctagaaacatctttttctaagaggaaaacaggctgagcacacagaggcctttagggcttctgcccttggttgtcttctatgaaaatccccatgggccttcctgattcctgccttcgtgacactgaacacctgtggaagtcctgttctcttactagggactgagatttggtttaaggtttttttgtttttgtttttgttttttcccctcatttcttaatgacatctgaactcaaaggttacttctgtagcatttcctcacctatgtgctgtgagggtagggtggtgatttcttcagctctccagggtggatgggaagggccttagctggccggaatcacccctctgggctgatggccttcaacaacctttggcctccagcagtatgtcataaaaataactactattttatgtgtgcgccattatctgaaaaaagctaggtggcactaacttactgcatgtatttatccttctgtataaagatgttcaacaatggctctactttagggaatacttcaccttccttgttagagaaaggaacatatgactggcaaaggaaactccaggataattaaaaacccttgtatgtgtcttcatttcacacattctttctctaggacttcttttgggaattagaccttgaaatagctcagacttttaaagatagagctgaaagttctattatatctagaatgaaaaagtccagtctaaatgaagaaacaatctttttgagggaatatataacttggggttgcggctattatagagtaaagggtaattagacttgccttcctgtcatagacaactctaacattggccaaaacatacaaagtggctgtttttaggcattggacaatacatatcacaagaatgtgatcctggagacaagggaagcataaaagtgagttttacatcaaccctggctttttgcctagaggcactttctaaattgcagcacagggcagtggagcccaaacaaagagtagcagactcatttattggatagaggaaacaagctgtaattcaggactgctggggtggctcaaattttcagggcagggaactgcaaaagaatgagctacacaaggaaagagtgtcagaaatgtatagatctagatgatttggccaaatactaagccaggcatcagtagggcaagactctacgaggcctggcagaaaataagaacttggaggggctgtgagctgagtggatatcccagagatcaccagtaatgggagatgttagagttctagctaagcagagtagaaaaacacgaggtgctatcctcgtgttgagaacttctggcatccagttgagaacccagaaaagccagccacaggaacagcactaccctagacccattgtaacaaagcctaaaaacccaagccttgaccagtcaagctgacctgcaagtaacctgcctaccatagcagaactcaacactctttcagggaagacaacaaaatccagtctttgaacaacagcatgcacagttgctcagcaactgttgagataatataatcgcaaatgactagatctgtgaagaagcaggaaaatgtgaggtggcttgaagaagacataggggtgtttctgagtacagttttcaggcattgatacctgcttcagttaatattggcatccccaagaggaaatgtgtttactgtttttttgtgtgttatccacccagtttcttgttgctagttatatagtatgtaaaaagaaaaaagcaaaagttagtatagcaaagcctgtaaattgttgcctgctaagaagccaggattttttgtaagtagttccactctgggtcatgacttcgttgtattacaaaagagtgagtgactgccagtcaggcgtggtggctcacacctgtaatcccagcactttggagggccgaggcgggcagatcacttgagtttaggaatttgagactagcctgggtaacatggcaagaccctgactctacaaaaaattaaaaaattagccatgcatgatggagtatgcctgtagtcttggctgctcgagagactgagtggaaggattgcttgagcctgagaggtcaaggctgcagtgagccatgatgtatttatccttctgtataaagacgttcaacaatggctctactttggaatgccactgcactccagcctgggcaacagagtgaggccccgtctaaaaaaaaaaaaaaaaagtgaatgactgcctaagccttagttatcctgtgatgttggcatttggaatgtagtgttttcttgagtaagctcgtccctaggactgtctcctcaggcttctttctttacttttggcctgccaggcattgcttctgacactgaatagtagtcagtgtagtcctcgttttttcttcttaccttataaaccatgatatgtggctgagcctcctttagtaactgatttatggggatgtagaaaattctgagagaaatcccagccatgcagaataattgcatctcttggggaggtgttaacaagcagaggcagagatgagtgcttctgggccccggcttccatggaactttcgctcaatagcccccacccctaagctctatgcagaaggcgttcattagcaaatattaaatgcctgtttccatactgctggtggatgctgagggtgtgaggccctctgggggcatgctgaggctcacttaacagcctcacccaaattgtccaacactcattttctcctcaaatgatatcagggaaggtcatgaagaacagccatgctggataacttctgggaaattgggactggggagcctgggggcagctgaccaccagaagtgactgagcagaatacatttctttttcgtttgcatcaagtggtgtacccatttttatgttttcagtttttggtttgaaatgtctgtttctaagctgcatgttcccatttgaactcaaagaagacacttacaatgcctgagaaaatgtagccttcctttttggggtaattttaaagtttttgccacaattttgaataaataataaattcagaacagatcagcaggtaaagcctgatcatatagatgaagcttcctttgtgtaggaattctatacctgcttcccccttgttcagtttgacctcacttctgatgtttgaaagtggagagaagtggaacaacagtctggaggaagattgggtcattcatctattcagtcaacatttattcagaattgacatgttccgggcactacggcaggaattagatggagacagaggtgtgaagataagaatcctcattttcaaggagcttatcgttttcaggaaccttgtgactcaaagtatggtccacggagtagcggcattggcatcacctgggaacctcttagaagtgtagaatctcagacttgccccagacctactgaatttgaattggcattttcacaaaatccctaagtgagaagcatgcacattaaagcttgagaagcgttcctcttaaatcactgattctcagcctacacactggaaaaacctagggacattgtaaaagcactgatttcctgtgcccattccccacccccaaattgtgatttaatgggtatggagtctggcccagacatcggcattttcttttaaattcccaggtgattctaaatgtgcagacaggtgtgagagccactcatctagtacatggctttgtactcttgacaaaacagcccaagatgagattgtagctcattctgttaaccaatgtacaagctaggtggcaagtttgtcttttctacagatttgaagtgcctagactagaggtaggcacaccaggtctcacgtgccctctctgtgcccacaggttgtatgtcagggagtcgctctcagctgtgtggagcacttcggccaggttacacggggccatgctggcaagattgaacagactgaggcccgatactgaagtctgggcaaggcctccttcctcagacacaccccggggccttggcatccctccccttggaccccctccaagtgtgtgagctgctgccagggggtttcacctgaggcagcagggactaggagtggctccttggcactcgaggatggcgctgggtcgcatgacaaatgcacatgagtgtaattaagcagctctcctggtcacattgtccctcagggattcggaccaggccatataatcacgatgatgacaataacaacaaccagctcttgtgtcactctttatactttgcaaagattttcacatgtgtcaggaaaccgagatccagggagctttcgtcactagggaacagcttaagtgtcacatggcccatgcttgctctgttccacctctctctgagttccacttgaacatgtcaggcaaaataaggaatggctcccttgtgacaaagtgagttccctgttataagcagtatgctaggagggagtagataacctgagatgtagcagaacgcagaggctggactacacaacgcctaatgctcaattcattcattccttaaaaggaaaaacatcatttgcattttatagggaaaagtatatgttaccctaatatctccctggtgttgaggcatagagaaaccattttggccattttaaggacttgagtttgaaagagtaaaaatgatatgtcagaaatatgatttctttccatattcttgctaagggtttaggtctactttcccctgagttcatgccaatagagcttatgtctaaacagcagctttctggaagcgtcatctacatgctgctccttttctcatttctacctcccacctcattcagagttcatcccctcacctgcctacaatgctctttctcatttgtattagagtctaaaactccatgaaggtgactgtcgtctggagttatgcctggggtcctggtgtaatttattaatagcgccccagatttggaaacaaattgtagtacttgggccacgttacctctctcctcagtggtcagctactgcctcaccatcctgccttcactcaacttctaccgtcttccttggggacatccacttccgccctgatggcagtcgggcctcacaagcggttgatcacctgcccctcctttctgcccctgtcactcagtgggtgctgtcttgcctcacacctcatatcactgttcagtagatgttggaggggcagggtttgttccaagctctaattcctgtatattctcttccatgagcacagctttcctctctccctcttctcttcctttacgctcagcaagtctgcccttgaccattctcattgcctcagttcttgtccttgttctctgcttccaggctgcccagcttgtcttggtcccacttgtttgtaaatccattctagcacttctgccagtgtttctgtgccattctgattcactgtgtctgcctctcccactagactctgagcttgggagccccacaaggacatgatggttttcttttctcccctggattcatctcctgtcctgcacattttagaagtctagcccagccattggcatttttttttaaaattcccaggtgattctaagtgtgcagccaggtttgagagccattttaggttctcagtaaataaactgaggccaggcgctgtggctcacgcctgtaattccagcactttgggaggccgaggcaggcagatcacctgagttcaggagttcaagaccagcctggccaacatgatgaaacctcatctctactaaaaatacaaaaaaattaaccaggcgtggtggcaggtgcctgtaatcccagctacttggggaggctggcgcaggagaatcgcttgaacctgggagacagaggttgcagtgagccgagatcatgccattgcactccagcctgggcaacagagccagcctctgtctcaaataaacaaacaaataaatagaatttgctgctattttatactttcgaaagcacagccctcatacaagtctcttcatctctgccatcaaaagactagttcttttgtctggtttgttgaagaggacttattttcacttctcattttgctgttaaaattattcctatttcccttaaattagcttgtattgctgggggaaaaaaatgccttgcttctctgtaaatctctatcccactccaggcatcctgaccctgtgcccactttctgtcttatagcagactcttttctttggctatttttcttgttttttttttttttttttttttctacttctgctagtagcactaaatcacactggcagttttctcttttgactgtacttatctcatccatggaccttgtgtttattcttgtaccaatcagaacaattagacatattgtgttctcccttcatgcttcccttctcttctttgaattatgcaatgagtagcactgttagtgttttccttaagaagcagaatatagatgggccatccaagccagtcatcaccaaggggaaatatgagacatacaatgtcattatgtaccattttctcccgtaggggtgtatgggatctaaagttattctgggccgggctcggtggctcacacctataatcccagcactttgggaggccaaggtgggcgaatcacctgagtccaggaattcgagaccagcctggccaacatggtgaaaccctgtctctactaaaaatataaaaattagccgggtgtggcagtacatgcctgtaatcccagctacttgggaggctgaggcaggagaattgcttgaaccagggaggcggaggttgcagtgagccgagatcacgccactgcactccagcctgggcgacagagtgagactgcgtctcaaaacaaaagcaaaaacaaaaacaaacaaaaaaaccacaaaaaaaaccaaagttattctggatgggcttttgctcattaacattttctatattgtttttctcacatgtgaagcaaaaaaggttcttgggttattatttgcataagactaagatgaagcatggatttacactgtttagaaagtttgagcccaggtgtggtagctcgcacctgtaatcccagcactttgggaggccgaggcagatggatcccttgagcccaggagttcaagaccagcctgggcagcacggcgaaaccccatctctactaaaaatatgaaaaattagccaggcatggtggcatgtgcctgtagtccaagctactcaggaggctgatgtgggaggatctcttgaacccaagaagtcaaggctgcagtgagccgagatcatgccactgcactccagcctagacaatgagagtgtgactctgtctccctgcaaaaaaagatagtttttttttgaatgccttttgtgggcatagttctgtatcagatgacctgaaatgaatgtggaaggaagaccagtcctcagctaagcaaaccattcacacatgtaaagatttcagattattgcaaaaactgttaatggttctctcctcttttggtactagagcactcatttgatccctgttacccaaaggaccttgcgtaatattgtatgtctgtctttcccatacatctctaagctccctggggttagagatcatgttctctgcatctgcatgtttaaggtttggtgcttacagagcttaaatatattttgcatttaatagatgtttattgaattgaatatcattaattgcaaattaacactgtactgagcattagagaaaagataaggcattcatcatagtcagtttcttaaaggtgagtttcaagttgagttttgaagaaacctaattccaagagttagggtcaaagaaattctactcccagcttccttcataagtttttctgttatcattgataatgtttgtaacatcctagggtcagaagaacctcaggagccaccaaatcctgccaccactcctgttcataaatcccttctttgaagactgatgctagtattcagggggtgatgtgacatgggcaggaccagactatctacttggacttctcaatgtcatttttccagaaagataagcatcctttcatgttgaaagacttttggacccttgttttgttctgggtaaatctgaacttgatacttcaagggtctttggttttttttgttgttagttggggctagaatttatagtctgtgactaaggactgatttccaaaatctgcactctcttccctaaggaagaccctaaggggtcagcttatctttgtaacagataccactggggcagtggaaggtggtgatgaattacttgctacctgaggtgggccttatgctaacttatagagaattcccacgagtttaggcagatagaggccatcctgttctacagtaattcaagtattggactggaggagatcgcagaactctcagggctagaaagagtctgcattgattctacaaatacttattatatgaggcattgtgtacatggctgggggtataatggtgaaaagtcagatgtgctcctcaccttgctggaatgtatgatctaacaaggtacaaatgagccatacaagccatggctctcccagggccctacagcaaggccttaggccagctgcacatctggtacttgagcccttttctaatcccactggtgtcgtggagaccatgggttctccatgggccctgaacatgatctcctctctttctctgtcaccttcttgctttcccttatgtgttatcagcaggtttttttgtttgtttgttttttggaaagccttttctcattttgggcttcagctggaagttgttgatcacgagacttgggagtctgctataggacaaaaagcaggctcagggtcaggatgcctgaagtgggatggagattaactgattacagggattttattcaaggaattttatatttgacagtggtgtgtatattatatatatactgggcaggaagcgttgcccaagtgaggaggtttacagtaggctggatgagccctgggtcaggcggtagaagtggaattggactcggaggacaaatgtgagacatatgataaaactccagcaaatgggacttccaaccagttgaaaatgggaaaaactagaagtggttttgtggcatgagattatgtgcccaggagaaccacgaggccattaggctcatgagaaaggccaggctcttgccatttttgctcgttgtcctttctctagcacctggctcagtgtccagaacaaagtagatgcttgataaatgtttgatgaatgaatgaacaaaatagagattatccaaagggaagcaagttcactctggaagaatggagagccttattcattcatttaggatgccaacattgcatcctgtaaagtggaggaagggattttcatgatggcaactgtgcgccatcaacatctaaaggagaaggtgaaggagagcagtgcattaatgagcttgtgtaaagtatgatttttcttctggttggctgactgtcacaaaaccttttttcaatattgacaagctttgtgacaggctaatcacatttgtgcatgtgatattttctaagccatatttgcagttaatgaaatacttttatttcagtaaaattaaaatgaagaaaacacatattctcccatccttaaagaaaaaagaaaggctgggcgcagtggcccatgcctgtaatctcagcactttgggaggccaaggcgggcggatcacctgaggtcaggagtttgagaccagtccggccaacatggtgaaaccccgtctctactaaaaaatacaaaaattagccaggcattgtggcacgtgcctgtaatcccagctgctgggaggctgagatggaggaatcgcttcaacccaggaggcggaggttgcagtgagccgagattgcaccactgcactccagcctgggcgacagagtgagaccctgtctcaaaaaaaaaaaaaaaaaaaagaaagaaagaaaggtaaaagaagaccttattgattcagggcatctaaaagcagcactgggttttgagtaccagccgacattgttaagcggacttaagcttttgttttcccctctgacattggggtttgtgctgacttggtaaccattgcctcattaacacggacctccaggaaagggcctccattctcttgaagaggggggttacacccctctggaggctgcttgcccccatctctcactctctgttctcctgttttctaggactgcatcgacgtaggctggtgggaaggagagctgaacggcagacgaggcgtgttccccgataacttcgtgaagttacttccaccggactttgaaaaggaagggaatgtaagtctccttcactttgatttcagcggagttgtggctcccatgttgggacttgggatgggggaagtttggtgtaatgttgaagagcactggcatttgaacattcaacagacccagattctgagccctcggctgccatatactctgtaacaagtttcatcataggatgcatctgttagctggcaacagtgatctctactctgcggttgttgcatacataaacaagatagtgtgtgtaaagcactcggtgcagcactggcacatttcagcacccaaataaactgtgagaaccttgggtgctctttttggtaagtggactgccagcatcccacatagcatggtccttgggggtgggaaagtagccagtgttgtggaagtggttgaaaagcacattgtaaggctgaggatgcagggcgaggcctgttaatctttctacactatatgcttacatgtgtgagtacacccgcacatatccgtatattagtatatacacatctctcatccacggtttctcttttgttgtgggagcccatttgaccatgccactgtttaaatcagccactccatctgtgtttgcctcactccaggtgtattctttccctgctgacgatgtaataagaaatattgggaagttagaagcactttccagtataagggaggagcaatcccatatttaggttctttgcccaggcttttgcgtggcctctgcccacctttcccagcctcaacccacttcatgtccatggggactctgttactggacggtgctgagccagatcttgccatggcacgattccagtagggctgaggtgtgggaaggatagctacagtgctggtggcttcgttgccaaggatactaaagtagcatttaatggaatttgtgctgctttgatgaatggatgtaattgtttaagaagctagatggtgttggcgcctgccaagattacggcccatagaccattaggttggtttaaaggctaagttagccacactttgtaagctttttgattgcttgctttcttgtattgtttaggtgaaggatgttctgttccacacctgttgttctctcttggagtctgagtttgggttctagagaatctggattctggttcttaatgtttcctagattcttgatgcttaaagtgagatccatggaccggcaatagcagcatcacctgagagcttgttagaaatgctcagaccccaccccagacatggtgcatcagaatctgcattttaacagcgttctctggtgatttgcttgcatattacagtataggaagcactagtgtagaagcaggtatctaagtgatgacaacccaccttctggtttcctcccccatcccccatattttaggagggaaataaattcacacaacagagaagagctcatcattcaataaggaaattttccaccaagcaaaatcacttgaaatgtttttactgatgactgtagcaatagtggattgtcatttgacaaaatcagtcactgagaagaaaagatactaaacacttagtagtgactgcataggaaatgttttgaaatagtaggacgcaggagtaaggatggcaaacattacaaagagtacagtggttgtgaccctaggctgtggcatcagatagatctgggtttgaatcctggttctgtcacttacttgttctatagccaaacccgagtcactgaatgtctctaagcctctgcattctcatccataaaatcatgagaataattgtacctaccttgtcgaagtgttgagagaagatttactgggatgatgcacataaattcttaaacatggtgcctagtagttggtaaatgcctcacacagattaactattccagtctttataattactatttaccacgagggtaggaagactctagctaaaactgtgaagtaatgatagaaggctgactctagttctttttgctccagctcatcaaatcaacacagttatcttggtatcttggcgagcttccctaggaatccaaatgcatctaaaaactttgataaatagccattagaaataaatctagcaacttagaaaatgtattggtagagacacgtgagcacagaatggcataatctttatgttatttgtcatggtttttttttctggatctgctgcctgataaatgttttattttcattcactcattcagtatttattgagtcctttctctgggctggccactgtgctggttgattgaaagtgaagcgtgcacatgggtactgtccttgtgagcttagagttaggcagttaggtctggcgtttagggccatggagacctgccagactcttctgaaaggacacttgatataggcctctccaagtgagtggaggcaagggggctgttcagtctgcccataccccgcttctcccctatctttgtgaggctggtaaaagctaggcacatcctgaagcatttgggcgccaagaccttcatggtgactcctctcccttcgaccaaggaatcttagcaagcataccatcttactagacatttgccaccttattggttctgattgaggcagtatgtttttttaattgacagataaaattgtatttaatgtttacaacgtgatgcttttaagtatatatacattgtggaatgactgaatctagctaattaccatatgcattacctcacgtcgttatttgtgtggtgatgggcagtagggttttgaagactagggtaaaatctagatcattcttttaacaaatgggtaaagcatgccttctaattcccagtcatgtcttgggggggggcagtaaattcactcaggtgagagctactccatacagtacttttctagaagctctgtgttacataagctattaagggaagcacttccaccaggagagtgaagttgtcagtgatgagtggactgggcatggcacgctctttgggacatgcacgctctctggggccccatgggcatctctctaatcccccacaagcagccgccatctctttgataagtcttttaaccttgtccttatgaagcagaaaacccaatttaagggaaacaatagtcatacccgtcagacaaagtaatacctatagctgaaaagtgattgtataacctaacatttaacttccagaaaattcaaagtataacatcccattccatctcctctggtctataaaaaccagccaaccatcttcacattggttgttataccagcctttattgctgcacccagagtattggtgagttggtgacaatgcgactggagatagggctgtcatttgctgcgctgagggtgtgaagatgattagaatcattaacacgaaggcactatgtgaatgctagagtctgaaacgttctgccactggtgtcagcagatgtcatcttgtcttgccagtgactggggttacaatcattcacccagaaaagaggacgatctgtgatgattagggtagacagaagcaaacggcatttattcaacagcaggcctcttgactccgtaggcatccgcagagcattctgataaggctgacatattttctgctggggtgtgaattcaggtagttactacaaggccttttggaattcctggccatctttctttcggagagtgcttagtggattctccctcaccagggtaacaaatgctttggggtttttcctcaagatattccagaagagcatccgttgatctcttggtgcatattttagagcaattatgtaagctatttataagagaacctagattcaatggctgtctgtttatttttggccttgacagtaaaattgaataccagaacggaaagattaaatattctgagaactctaatgaagcagtgtgtgtgctgtgtcattgttacagaaggctaacggggaacttagactctcaaaaacagcagaaacaactgctcactgtcattaaaaaaagaacaaaattagaataggtattttgaaagatagtgttatttaagaaagtggccagtgtggtggttcatgcctgtaatcccagcgctttaggaggccaaggtgggaggattgcttgagcctaggagtttgagaccaacctgggcaacatagcaagacccaatctctacaaaaataagaaaaattagctggacatggtggtacatgcctggagtcccagctattcaggaggctgagtttgggggatcgcttgggcccagaagtttgaggctgcagtgtgctgtgatcatgccagtgcactccagcctgggcaacagagcgagaccctgtctcaaaaaaaaagtaaatctcaggctccagttcttttaagagaaactgttcaaatcaccagaagatattactgatctaccatgcatttatttggagggctcttcagtgttagtgcaagtcaagaatgatggcattgctaagattcccataggcgtttccctaatgaatgctccccagtgggagctcagcctcagggactcagaaacctgccctcgaagatgtccctgtgagtatgatgcaggctcgcctttgctgagtcacagagacttaatcaggtagcaggcagccagcttactcatcacaacaagaactcagatgtcagccagtctggaacgcagaggtctgcctgccccggtcattttgtcccctatgggtctgattccttagaagccgggttccaccagaagccacgtttatccggtgctttccgggagggcaaggaatcaaaacaagaggagtttgttgttcttaccaagggtctggcaggtatcacttgaggctccttcatgcaccaaagggaaagatctgccaagggaaccatgtgttgaagtcaactaagccttgatgatacttctaagagcactgcaccactgccttcggcctccatttgtctttgttttcatgactgactggacccttcctgttcacatcaatctccagacacattgtgatgcaatcagttagatttcccactttctccattataatcatgtgccaacccaccctcttacgattttttttagcacaagttttgcaggttccaaacttttgcaagaaaggaagtctcttgctcgattcccacaatggccgaattttgctggtttaactctaccttccctataccaaattcgtaggaggcccctcaccttacttagcctccatcttctgacaactcagtccgtaaaatctgttcttagtcaacattttctttattattcatcatgtcctttagcctttagccctggccctaatttttatttagaatcatcttaaaagacatcttgtttgaaaacgtggcatctataacaagaactgttgtttttctagtttctgaagatgcccgataatttccctattttttagccttccaaaagaaagaaatatgtgcttctaataagcagccttatgaaaaaaatttacctaaacattatctgtcttgaacatttagtttcatgggtggtttcacatgcaaagaaatggggtttgtcaaggagttaatgtcatctgagtatggcctattgactcagccccagtggactttctcaaagccacccagatggtattccctctcccttctccagctgtacttacagcctgtagtctttgaaggcagagcccatgtcccaagcttctccttcatggggccttacagcatgcatggtacatggttgctggtgaagaacccatggtcctttagttggttggtgccagagtgtatcttctcttcctcctgcctctcctctcctgcttgctgctttctcttgtacaaaagaggaggaagagtggaagggaggggcagggggaagctggcctcctgtcagattgtccttcctagaccaagagaggcccagatccttccatctgatcatggggtctgggcatggaatcaaggcatcactttcagggtggggcagatggaatgaaggggtgagccaaggggtgaactgtgagagcatcttagggagaaaccaaatgccaaggcctggctgaccacccaataggccatcagtctgaatgggagatgatggatgtagaccactaggccagaggctgaggaaggaaactagagaaagactcttccaagagcagattccctaggtccctggggatctccagtgcgggtgacagggcaggcagttgctggggactctatagggtacagaggtgcagtttaagacactgtcatcacctagagcatagctttagctgcacatttcaaaggtgtggctgttcctctaggggcaggggagaaaagggcagagtggagatccccatgtgtttctagagctgcaaaggggtgccctaatcaggagctgtccatttgtgtcccctctccagcctcacccacagacaccgccagagaacttagtgggatgtgtggaggaggtctcccaaagtccagaattgctgaaaatcaagctgagacttacttccagaacctcaccatattcctctaacgaagccctttaaaggttacccagccatcagggtacacttctgtttgtgtttgtttgtttttaccaaatcacatctctggggccagagctctgaaggcaaaccagctcaagaggcaaagtagcaaaccagattcctgccaggggaacagttgagccagccaatgagccttttgcttgggaagggccagtcttgccaagcaaagggcagagtcagttctgaaatccttcacaggaaacaaagcttgtcttcctgccattctcattccagaacgtttatatctatttccttcctggtaatgtaaaggtaaaaatcaaatctagctaatatatcctttgaaggatggtgtctgcatgtcttggtgccagccaacaaccccgcacacaagcagacacagacgcatgtgcacttaggcctgtgctccctccatatatgaagactatggaaggcattcggctctcccagaaatcagaaaatgtgggttcattgactttgttaccattatattcatgttggttcttgtgaaatgaattcccgtagtctggacattgagaaacgtagagttctgggccctctggctaccaactagctgttgaaacagcctttctgggcctcagtgatctcagctgcaggggggactcctgtgatgacttgcagctcttaatatccactgtttttttttagcacttacctgcaaattgagcaggctgaagccacctgaggttggagctggagcattttaccttcaccatggagggagggataaagagaataaacagaacaagtgcctctagaaactcaggacttaaatacttgcctgagttgaaaggatgtttttgggtgtgcacctataggagctggttaatatcttattactgttaaactccacacaggaaaccttgacctactacttagcccggaggaccccagccccattttctttatccagtcacaatgggatgtttggagggaaatcaactaaatgatctcttcatgtctttttatttgagaatagtgaactcctgtgatgaattttctactgtcacattttgctggagaatcacctgttttgccttctcagttcacactgccttgtcttcctgttgcatttaaaaagaaatttttaatttgtttcatttttttttttactgagacagggtttccctctgttgcccaggctagagtgcagtggcacgatctcagctcactgcagcctctgcctcccgggctcaagcaaccctcctgcctcagcctcccgagtagatgggaccacaggcatgcgccaccacgccggactgactttttgcattttttgtagagatgggttttcactgtgttgcccaggctgctctcaaactcctgagtgcaggcaatctccctgccttggtctcccaaagtgctgggcctgttgcatttttttttttttttttttttttttgagacggagtctcgcccactgcaagctccgcctcccgggttcacgccattctcctgcctcagcctcctgagtagctgggactacaggtgtctgccaccgcgcccggctaattttttgtatttttagtagagacggcgtttcaccgtggtttcgatctcctgacctcgtgatctgcccgcctctgcctcccaaagtgctgggattacaggcgtgagccaccgcgcctggcgcctgttgcattttttaaaaaacattgtaggcccatgtgcaatactttatgaatcattttggggagggggacagtctacagccgcatagaaccctggtcctgatttttatttagaattaccttaaagacatcctgtttgaaaatatggcatcttttctcctttgaaaaagcatgaaggctaagtttgatggaaccagagaaagtgaagtcagtaaaggattaaaaaagaggaaaacttgtgaaccccctctgctagtaagcaaagcaggcacctggccagcattgatcaagagtggtagatgcaagacagacagctcacaaactgttccttcctttcaaaactgtgctcccaactgcctctgcaactgccgggtttccgaacaaaacttcacacttctgtctctgtcctttgccacattcacacacatgcttgctgtgaccacactcttcatacactgtctgttagtgcaacattttcctctctccctcccctggtgcccctctgctctgctctgtcacatttcatgtgtctgctacatgctaaatgtgacacaacattaaagggattttttttttctttgaccagtaatcttggaaaatatgatgacttgtaattgtcgtttttaaatttggggccctgtggtttgaggcaaggtcgctggggtaatggcctcagcgaaaggaggctcatgtgaaattggctatagaaaaattcagaccagcaaggagtgaggaagatgtccaggggtaggtgtccttgggacttggctgggaagaataaggccacggggtgttggcagttttgtaaataaggaatgacaggcatacttcattcttctgtgcattccttcattgtgtttcagatattgcgttttttacaaattcaatggttgtggtaaccctatgtggagcaaacctactggcgctattttcccaatagcatgtgctcacttcatgtctttgtgttacattttggtaattctcacaacatttcaaacttttttattattattatacctgttatgggtaatctgtgatcagtgatctttgacattactattgtaattgttttgaggcaccataaactgtgcccatataagatggcaaacttaattgatcgatgttgtgtgtgttctgactactccattgacctacgattccccatctctccctctccttgggcttcactatttcctggtatgtaacaatgttgaaatgaggcaaactaacagccctgtgatagcctgtaagtgttcaagtgaaaggaaaagccacatatctgtcactttaaatcaaaagctagaaatgatcgagcttagtgaagaaggcatgttgaaagctgagacaggccaaaagctaggcctcttgcactaaacagttagacaagctgtgaatgcaaaggaaaaatttgtgaaggaaattaaaagtgctgctccagtaaacacatgaatgataagaaagtaaaacagccttattgccaggcatggtggctcacgcctgttatctcagcactttggaaggccaagatgggaggatcacttgagcccaggagctcgagaccagcctgggcaacatagtgagactccatctctataaataaataaataaataaataaataaataaataaataaataaaaacagacttgctgatgatatggagaaagtttgagtggtctgaatagaagatcaaaccagccacaacacttctttaagccaaggtctaattcagagcaaggccctaactattcaagtctatgaaggctgagagaagtgaagaagctgcacaagaaaagttggaagccagcagaggttggttattgaggtttaaggaaagacaccatctctataacataaaagtacaaggtgaagcagcaagtgctgatggagaagctgcagcaagttatccagaagatctagctttgatgaaggtggctacactaaacaacagattttccattgatgaaacagcctttgattgaaagaagagataatctaggactttcatagctagagaagttgatatctggcctcaaagcttcaaagggcaggctgactctcttagtaggggctaatgcatctggtgactttaagttgaagctggtgctcatttaccattctgaaaatcctggggcacttaagaattatgctgccagacacggcagctcatgcctataatcccagcactttgggaggccaaggcaggaggatcacttgagcctaggagtttgagaccagcctgggcaacatagcaagactccatctctacaaataataaaactggccagttgtggtggtgtgcacctgtggcctcagctatttgggaagctgaagtgagaggatctcttgagcctgggaggtcaaggctgcagtgagccatgatcgcaccattgcactccagcctgggcgacagagtgagatcctgtctcaaaaacaaaaacaacaaaaaaagaattatgctaaatctactctgcctctgttctatagatggaaaaacaaggcctagatgatagcacatctgtttacagcatggtttactaaatattttaagcccactgttgagacctactgcttagaaaaaaagattcctttcaaaatattactgcttattgacaatgcatctggtcacccaagagcccagatggagatgtataagaagatgaatgccgttttcatgcctgctactacaacatccgttctgcagcccatggatcagagtcgtttcaactttcaagtcttgttatttaagaaatacattttataagtctatagctgccgtagatagtgattcctctgatggatctggggaaagtcaattgaaataattctggaaagggctcaccattctagataccagtaagaatatttttgattcatgggaggaggtcaaaatatcaacattaacaggggtttggaagaagttgattccaaccctcagggatgactttcaggggttcaagacttcagtggaggaagtaactgcagatgtggcggaaatagcaagaggactagaatttgaagtggagcctgaagatatgactgaattgctgcaatctcatgatcaaccttgaatgaatgaagagttacttcttatggatgagcgaagacagtgatttcttgagatggaatctactcctggtgaagatgctgtgaacattgttgaaatgacaacaacgggtttagagtattacatatgcttagtgataaagcagtggcgggatttgagaggattgactccagtattgaaagatgttctactctgggtaaaatgctatcaaacagcatcgcatgatacagaaaaatttttcacgaaagaaagtcaatcaatatggcaaacttcattgttgtcctattttaaggaattgctacagtcaccccaaccttcagccaccaccaccctgatcagtcagctgctgtcaacattgaggcaagaccctcccccagcaaaaagtttacaactcgctgaaggctcagatatcattagttttttctagcagtgaagtatttttaaattaaggtacgtacattgcttttttagacatgctatcacacactgaataagctacagtagagcataaacataacttttatgtgcaccaggaaaccaaaaaaattcctgtgactcgctttattgcagtggtctaaaaccgagtttgcgttatctctgaggtatgcctgtactctgattccgaggtaaaggaaggttaactggcagaacttcactgatacttttgttaggtaaacacacatctgtccccaggataattaacacaacgacagagaagggaggaagaaaaagagttagtagagagctagaaggggctggcaaaaggggaaagaataatgtgagatcatgaggcagaaacacatccatcccatggaggacctgtgtgtaagggcaggtggcccttagagcagctttctttattttaataaagtatatttctctgcactcatagagacaatacagaaaaacattaagaatgacacacacacgtgtgcgcacacatatgcacccagaatcagagatcactgcttccccctaacacagctgtctgagaacagtgccctggctggattttttggccatggaataattttccaagtccagcctgatcatctctctcccacagtcaatcctaggtggcaagaaaatgctggctactctggaaccagttcagggatgaatgccattgattgcactgctacctccatcacctacagagtgacagcatgtgagaaaaacaaatcacggctgatatgcaaaaaaaaaaaaaacaaaccaaaaaacaacaacaaaaaaaatccctctctgttccagtttatcacatgtacaatgagtctgtggggtgtctaacaaatggcctgccagcctcggtgtagaaaggggcagaaggcttgcaacctgatgtggctgcagtgggccctcagcctgcattttgttgagagtcctacatccagagcagattcaattttgaatctttacagtgactcttttcgaatgcatggttattcagcagattaaatcttaattgcaaatgcagcttcagcgtaggagtaccattgtgcttgctggtttcaggccatttttgctgagccgtgcttttccagaaggctgttacaaatttagaaagggggaaatggcgtttcatttgtcgattggagttttgttttgccgactggatttattttagtgtttgtttagaggtgccaaaaactgacgtccctggagagagaattgctcaatttttttggagaggttctctaaattgtccaaactgcacatagaaaacaatgtctgtggtccttctgtgagaggacaggcttgccaacaatctcatgtggtataatttttattaatttttcagagacccaagaagccaccgcctccatccgctcctgtcatcaaacaaggggcaggtaatgtacctttcagttccatcaaataaaatatgcgtctttctttttgcatatattcaaatcatcctcagtgtagagttcgggattcctggttcaagtgccatagattgactacttgggaagttacgatttggtctcagcaggcaggttttaaagatacttctgtttttcctaaaagataaacataccattaaaatgtgaccctgatatagtgtaaaaatctaggctcccaatgagaatgatcagaaagaattaaaacaaacaaacaaacaaacaaaaaaaacaagtttgggtttttttaagtaaacagcttttgaggagaaaagaactgaattgccctgtttctcatgtgcccagttgaaggtcagcttagggaagattgtttcccacaggtcatagcattgttgtgcgtatatagtgttgctgaattttcgatatctgtcccatgtggttaaccaaaatttgtactgacttcacttacccctcaacaaaaagatgtttttctagcaataaatacttttccttatgattcttgtttaattttgaagagtctaattcactttttttctgtgtagttcagatattcaggttgaataatataggaagaattgatgttgaacatttggtagcttgtttcacactggattctcatatataaaaagatatttcatatttcccggtagaactcctctttataatagttaaaattaattatagggaaaaattcctccatgagttattagttaagtagcattttaaaaaattaacaactaaaatagaagagaaagggtatttttagttctacacattcacaattatatttctataacagttaaattatgaataaatttcaagattggtttatttataaacttattaagaagtgatttttaagttcttttggcccaccaagttaagaggaaaaacttgaccccaaattcctttcccattccctttggcatagttgagaattattagagattaagtcctgaaatgggatgttaattacatcttttgctccgcccccatccttgtttgcattgagcagtttcattttgccacctagtggttctgcccatatattttattgtgctgaaattgaagcaagctatttatttacttttctctgaagacccctttccctgtaggccttggtaattgatcagagaccgtggagattagttgaggagtccaaggctcaggcagtctagaatgtagctaagattggattcttcagtataataggattgtcagttctttctgtgtctctaggaatgataccgacttcattattgttaggtgagtagattgtagcatggtaggcaaattcttacccttttaaaacaattttaccaaagtttatgatgggtctctgtggggcaaagcaggatggcatttaatgtttatagattactgctcatttatcctgcctgaatgatcgtgggaactgctttgtaatggggagatagatattcatattttctccctcgtcaactttccttgcgtttgattattttaccaaaaaaaaatcagatatgaaattgacagaaatgagatgtggtgattaatttgtagtgagtcattaagaggaattaagtaaaggatgtgtttggtggatattttttttaacttcttttgttctctgaggttgtgtaattgagatttctagtaccaagcacccatctttggaactggtcatgtaaagagtttgttaagaactcagcccagtccatacataagaggagtacttttgactggtttgtgctttagctatttctcaagtgctcttacatgcctgaggccactggcaccaatgaggaaaccccaggtaagggagcagctgcagtccatgtgggtaaaggctaagtgctaagtggtacatttgaaaaaatgtaatacttgaaggaccccaaatttggtggcataaaacaacagccttcttatgttcatggattctgtgggtcaagaacagaccatggctgggctggcttgtctctgctccgtcatatctgggacctcagctgggaatactgaactagctgaagctggaggatccactttgaagatgaatgtttccctcacgtgtctggctccccttggcaagggtgcctggaaggctgggctcagctggggctataggctggagcatctgtatgtggcctctccagggtagttgacttcttacatggaagttcagtattccagcaaataaagcataaactacagggacttttatgactcagctttggaagttatgtggtatcattcctgccactgattgaagcagtcacaggcccacccacattcctggcaaggggatgtagacctcacctcttactgggaggagtatcaggtaattccaggccctgttttaaaatggctacaaaatgggatccagattcctatgaaaccccctttttttggtagaacacaacattcagtggccccttatttgtaaagtttgataattgacatttatttatacacattctccacccccacccggtgatttcctgtgactatattgatgcctaaggaaatcaggcttaaatatcagaaaatattattagtggtattcttgtaaattaaggatacataggcaggtgaacttaatgacataggccagaaatgtcttctgctctgtttctaaacagctcgtgcttgccagataatgctaacgcccaactcaggggaaaaaatcttactgactttgctctacctgataaagatttaaatgctggtgggtgtaataattgagtacagaaaacattttgtgatcactattaccctttccctcctaggcaccactgagagaaaacatgaaattaaaaagatacctcctgaaagaccagaaatgcttccaaacagaacagaagaaaaaggtatgaaatcaattcttcattggcacttccagaacagcaggagctgaagctgtctgttacacggctagtccagaatacccacagaatttgcttttcctttggaatatggtgatcatggttttgttttgattgcttttacaaatcctattgctaaggaagtaggagagggttatgtggtacttcgtgggaccacaatttctcatcagatgaaaaataaccagtctagtcaattaacacattgctgctgtttcctgatgtctctaccatggccaccctctctgcaccctgaagtcggatgtaagttcctttagggcctggtatatatctgtcagtttccacttagcctgtccttcatgcctagtgtcccaaggtgctcattcactgttgatggatggatttggcatagtgaaattcacgtccagataaataaacaaatgaaagctcttttctttggtcactcatggacccttgactctgggtaacgttattacagacagaagtccttggtcaaggatgttggaggaggggagggtggcatggtaatactgggaaagcagcttggtccccagcgtctcctgaaggtggtcaggagtgtcattggcaggaaagtaggttaatgtgtgtcctgcaatcaggtttatgaacgcgtttgactcctaccattttgagagtctctcccaaagaattctgcatactgtagaaggactcattttattaggtgtctaggatttgattgatcacacatttttatgggaaaagtgctatgttattacgaacaggaggctgagcaaatcccattttaaaaagcagttatttttaagtcacaagagaaatgctgaattaatgaatgtaattatttggaggtgctccttggtggcctcatgaaattttattgtgaaatttgatatttgatatcagcctgccaaaaattttaccaacattgccagctcttaagaagctatacctctttctttcacagtgagcagttagaacttgacttgtggaacctcattgtgaaggccaggtctgtgtcacggattgaagaaaaaaaccagccattgagtatatactatatgaataactctttgtataaaagcattggtatggccaggcacagtggctcacacctgtaatcccagtactttgggaggctgaggcgggaggatcacttgagcccaggagttcaagaccagcctgggcaacataacaagaccctgtctctaccaaaaaaaaaaaaaaaaaaaaaaaaaaaaaaaatagccaggcctggtggcctgtgtccatagtcccagctactttgggaggctgaggtggaaggatcgcttgagtctggaaatcaagactgctgtgagctgtgaccatgccactgtactccagcctgagcaacagagtgagaccctgtctaaaaaaaaaaaaaaagtgtgtgatgtgaaataaccagacaccaccctctgtcctcatggaggacacatggctagtttctgggtaatagccaggctccgtgatggggacacttcctgcactagtccatgctgacatatggactaggcttacatgtgaacaaccaccctagttggctgaccaagtggccccacatctctggttccttcctctcccatgatcccttgttatatgccacagcgggtgagggacgtagaatccctggtcagatgcaatagggaagccagggaatcagccctacccggatacttggtttccctgttgggtcagcacaaactcccttttccattcatccagcaggctgctggagttcctgtccctgtcctgctgcaataggagaaatgtcccctgctttgcatttcaacagagcccttcctcctctggcccctgtgtgccataaaatgagttgccagcattcctgattggagcatatttccccacattgtggggatgagcataatagtacctgatgggtttatttttattttatttttttagagacagggtcttgctctgtcacccagcctggggtgcagtggtgcgattgtagctcactgcagactcgaactcctgggttcaagatcctcccgcctcagcctcccgaatagctgggactacaggtgtatgccaccatgcccggctagtttttgtagagacggggttttactgtgttgcccaggctggtcttgaactcctggcctcaagtgatccttccgccttgccctcccaaagctctgagattacagatgtgagccaccgcgcccagccctgatgggtttttttttttttaaccttttgccaaccatctgggcacccaaacaacatgagtctgtgtttgcaagtagaaggtgtcctgagtaccatcttacaagtaagcatagggagcctgcctatagtccgttgggcaactctctcaagttccatctttatcaagaagaatgtggatgtatgctttttatgccacacacggagcaaggctagttgggaacagaaaatatgaggttgtcactgaacactgcccccgttcggccaacagatctggcttcaacttcattctaatatctgtgactccaaaaagccttggaaaccttatacctgtgaagtcctagtttgccttccaagttcaaacttcttgtgcgcaagaagaatccagaactcattgttccctgaaatgctctcccttttatttgctcatggcccttttcagaggccagcctgagacgtgtcaggcctctttccttcccatacccagcaggtcccgtgggccattgaccaaacccctcagccctctgctgagccctgactccatgccagcaccacatacagctctgaggagatgaccagacttgggccctgccctcaggggctgtcggcctacaggctgtgccaaacatgcaaacacccagaaagtgtctgagcgtgtttgtaaagcgctgccctgtaatgctcaggtgaggaaggaaggaagtctgcctttgagctgttgggaagggaacatggcagtgtcacgtttcagccaggcttcgaaggaagagctggagtatgctgaaggtgggcggtggccagaagggcgcttcaggcagaaggaccagcatgagtgaaggtgtgcaagggagggaacagtgagctctgtgggacttcttctaacctgacaaagaataagtggtgctcttggccttccatgatcaccttcagaaatagcatcagtaattttttttttttttagcaggaaatgagtgatctgcatctaagtactgtcacttacactcgatctatctgttttctttaaacaatgatttaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggtactgctgtgctctcacctccggggcgggtgtggggtggctatggaaggaacacaggaggggaactgactgccacagaccttgggaggaagggagaggagaagggggtgctcaagcttccctcttacatcctccagcaaaattatctgaagacaccggccacttctgtccttgctcctgcactcaggcaggagtgagtgtgaggttgaggggtgcggtgtgggtttcatgaggactgggtacccagcatttaggccctgctcacacacaggggtttttcctgggccttattagaagcaaggccaactgcccttcagcctggaaatgcaggtggcgtgtccctctttgtccccctggatgttgt

SEQ ID NO: 3242 - DNA, 107017 bp, human
ctggaatgtttccttccaacttcatcaaggagctgtcaggggagtcggatgagcttggcatttcccaggatgagcagctatccaagtcaagtaaggaagtctaccctaccaagcaggagaggggcgggggaccggcaggctgtgctccagcctcccttctgttctgtatcctatgccgagaggctatagtaaacgcttacgagtatttttttggttatactgccttaacccactgtggtttaggaagttgatccctataaaggtgtgacccgtagccacacattctgtatgtctctggataggtaactgccagccttcatgccctggtaatactgtctcatgggtggcccatgttgctgtgcctccatatacttctagagtgttgcttactgtaagttcataattatttaaaaaatgaaccaaatgggattgtcagtatttctcagcatcccttgagggacttggagaaaaattaccaaagaaaaaaaaattactggtggtgagaagtgaagtgctatgacaagatgagtgcatgccaatccccttaaaagtaggtcaagacaactgagagtccaggtcccaccttgggtggtgagcatgtgtgtccttctacgatggtgacaacgaacttcaggtctttctttctccagggcctgaaggtctccctccagcttctctgctgccctttccagctcacggagcaaaaggtcaggaccgggaaacttcgttctcccagtcactaacccaactgtgggcgtctgtgtatctcttgtgctgtcttgagccaaggtcatgggcatgaatgttgtaggaggctcgactgtgcagcactacctggggttgcagaatttcctttctgacaagaggagggcagcttagtcctgcccaaatcattcttaaatgtcttcctttttcatttggaaaaacctgacttgagtggtgttctcgtgttagtttgtgtctcatttatttaaccagtagtatgattagacaagtgtctgatttggaggtaacgccatttgcagagaagtgctcaagcgacttccttcacttggtgtctcagcagctctggatgatgtagcctgacataccgagaaacagcagcacttgctggttatccagtggcttcagcagtgctccttccctccagtgccaaagcctgggaccctactacccctgaaccccattccatcctagagtctatggtaggaagcactggaaggggttggggggggaaacgaggtgtcttggagctcctgttgccttctctggctcagggcagggggattctctattaacatggcccagctgatgagtactactgggaggggagaaggtgtccttgatctcccattagtggaaattactattgctttcaaaatccgtgttagaattctagctgccctggtgtcttctcctgtactctggaataactattgtacctggtaattagatcccataataacaatactctatgtcagggacattgtggattaaatgggattttttggagagaggaccaaattgggtcattataacattatttccatgaataaattcattacaagttccagtagcaataatgtgcataaaccaccttgctccatagcagacccataataaatggtagctctcactgttagtcaagataactgttgagacataaccagttagtatcagttgcttggaggttgcttgcatactgagcgatagcatgttggctgaggcattgtgactgcatttggaaattactttggagttcctctactgatgcagaggaggagatctggggaagtattagacaacctctttggaaaagtcttgacatattggtgtcctgccattttagctatgctctcagagctggaagatcagaggagtaatgcctcttgtatctttagaactattgaaacaaattgacttctctcattccaagtcagtaatatggacagttcaccctgtctgacccctcagctaaaggcatatggtgctgcaattcctggtacagaggattaggaggttgggcggaatggtcttcccatttagcattatgtcatcacctgctcagaaggggcattttctcttctggagactgttccccccaacacacttactgaattaaaagccttccatttcaagaccaggagagcccagtggtttcagcagccatgtttagttgccatttttgaggggattttgaatcccctggagaggcatggtcccctaacaaggatggctgcttctgataaaggatacatggcttttgtaatcttcctgcatgtacagttaaggaaaagagggcccatctctccatcggttggttcatatccatctatctatccatccttctttctctccttccttctttcttccttctattcttcattcattctgtctttattggcaccccattgttactaaaacactgtccaaggcactgacgatatacagagacaaatcagacagggtccctgctttcagtaagctcacactgcagaaaggggacatgcaaacccgagttcagcaaagtgtccaggtgctctgcaaagtaagcatctgaagaagagtggggcacaaagaggccagtcccatggggatgtggggcttcatagaagagcagatgtgagaataatgaatagcttgctaaattgaagtaattccctgaaagagagaaatagtatctctcagtgttctgacagaatttccagtagcaggccaggcatggtggcttatgcctataatcccagcactttgggaggccaagacaggtggatagcttgagcccaggagttcgagaccagcctggccatcatggtgaaaccctgtctctactaaaaacaaaaaaacaaaaattagctgggcgtgctggcacatacctgtaatcccagctacacaggaggctgaggcatgagaagtgcttgaacccgggaggcagatgttgcagtgagccatgatcacatgactgcattccagcctgggctacagaaagagactattaaaaaaaaaaaaaaatatatatatatatatacatacacacacacacacacacacacacacacacacacacacacacacacgtatgtatatatgtgtatatgtatatgtgtgtgtatatatatgtgtgtgtatatatatgtgtatatatatgtttatttggtatttgcattcttcacatttctgcttccagaaagtatttgaagtagttactgagttgaattttgtgtaccaatggatgaatatgatagaagaaacattggcattatatttataagggagtatgccaagactgcttgacacatggtaggtgtttaataaatgcttgttgaatccccttttactataaggaggcatttttatttttgaatgacaggtgaaaatcttttgaacttgcttttctcttattctgatgtatttttccatatcgtggttggttatgaaagtctctaaactttcttagatctttgtttagggtaatctagtctatcaaggaaagaattgcaacgattgtattggtggatattttatccattttatctcagagaggaaaatttatagttatgtagtagcagaaacttttcactgcatatttaaatttgaaaacatctttaccattttcagaacttatgaaaccttaaaggtagtttttcaaaaaagattcttataaacttttttattattgaaaatttctaacatcaacaaaaataataatagtataatgaacctctgtgtacctatcactcagcttcagcaattatcaacctttggccaatttgttaaaattatagccctctgcacgctttgtccatattatcttgaaggcaaaccccagatattatataatttcattcataaatattttaacatgcatcagtaaaagagtgtctttaaataccatttatctcacacacataaaattatggcaagtccttagaataattaaacacatggtcactgttcactttcccctaaagtcttctttattgcaattcatttgagtctgtatccaaataaagtacatacgttgcagttagtcagtatgtctcaaatctgtttgaatctatagatttctccttcatatctcctttttttcttgtaatttttttgctaaagcaactgagcccctttgtctattaatttctcacagcgtggcttttgccgatttcatctctgctgtgtcattaaatctgtattcctataaattgatcattagatctggggtcttgattagattagatataaatataaagcctgaaaatatatatatatatatataaacctgaatatatatataaaacctgaaaatatatatatatatatataatctcaaaagatatatatatatatagagagagagagagagagagagagagagagagcgacagagattgagtgcgcatgcgtgcgtgcgtgcgagagtaaacctgccacctaggtggtgatggataatccacttggaggctcataatgtctggccgtcctactttttgaatgttagcagccattgataattgtctcccaaacctagttactcattaggacttgcaaagaggtttcaaccagaaatttaaaaataataataaaatgggctcccatgtaacagatcaatagtccaaaaaagtgtttagtaaattaggtttttaaaaatcaaaacagccaagtggttgtgctaatagtgtaggcagaatcttatgatgttaaggtggaaaggaatttagatattgtttaactcagtgtcagatgagaacactgaagcccagtgaaattaactcccaggcttctgagtgatggggagaaaatgacatgcaagccttccatacacattctggtgctgcctccattacacaaatagtttacctttccacaggtcatctgacaaatttcaagcctgagtacagtttagcttatttcttcttattgtcacggatcatgattagttaattgccttttcagttacagttttgcacatgctactgttgactaaataatgtgcagtggcaaagaaatccagatacgactgttgtccaatttcaatttcatacatattttgccttacatttaagacataaatatgtcttttctttcacatcctttgatattatttgctttcaaataatagttgtaaaactaaaagtgtccctgttttttaattctatagctacagaaacattttcagttatttctcacaatcttcagagggagaaagtttgcattttctttctgtaaccattaataaccatgagttttctgttgttattgaatttctcattttcctaattccttatttaaaaagttgaggttctgataatttagtgacttgtcaggctaagacaaagatgaagatggaggccaggtgtggtggctcacacctgtaaccccagcactttgggaggctgaggtgggaggatcacttgaacccaggagtttgagaccggcctaggcaacatggtgaaaccccatctctacaaaaaatagaaattagctagctatggtggcatctgcctgtggtcccagatactcaggaggctgaggaaggaggattgcttgaacccaggaggtcgaggctgcagtgaactatgattgtgccattgcactcgagcctgggcgacagagcaagaccctgtctcaaaaaaaaaaaaaaaaagagagagagagagagagagagaaagatggtttttaaaaatgtatagcaaaccactgccatgatgcagaaataattgtgtttcattagctgtaagaaatggattgctcagcgtcccttgcatataaaaatgagagccagtctgacaaatcccactctgtggcatcattagactttttttctttttaatattagatgatatttgtttggagtatgatggtctattagcaatgaagaacgatgagcaaattgatgtgatagtttcaggcaaaattagatgctagcataagtgtatagttttgtgtgtaaattttaaaactcttcccttttatagtgtttgctgccttcaagtactaatatttaacagtgacagtatactatttcccccagtaagatcaacgtcactcatattcataacctttccagttggctgcctcttttgctcttcacacaggacacctatgtgtcctcacccagccccagcccagactacatctcaaattgccttgctgccaatgcacagagagactttgcaggaaggcttaaccattcagagacatcagagccatggtctacctcagtgactctcaggcttggtgttagggaagaacacatggaagttttagtgtacttaaaggaacattatcgaaatactgcctttaaaaaaaatcttacacttcctttttttctgacacttgagaggactgctgttgttaacttttggagggcctagctcacaaaacagctgtgttctgaggagtaatggtgacttaatgactgaagttaagcagaattgcccgaataaaaactagccactattacttgctgcacttttgtcatcaaagtcctcaagagcttcaaatctagcaagaacatttgaaactttgttagtcttcagattattcttacacagccagtgatttgaatgcctaagtttttgctttaattggatagaatgcatcggtcaaaaagggcacatttcaaaaggagggtataccaccatggctgtaggacacggaaattggaaatacctgatcccatttaagttgttggtcttctgatgattcacaattcctttcctatatggggagtgccaaggcccagaagctgacagtgtggtttctcttgggtttcccattttaacatggagtgtttctaagaagtgagacaagttgctctctcccttcacttagttctactccctgcttctctgtaaatgtagcctagctttttcatcctccagacttattaggaagctgtatgactggcctccagtttgaatatttaattaacaagccataataaaatttatttctcagataatttaaagtaatatgtttattaattgagtttgcctttagcaaatcattttgcctgtcggtggtactctctgtagggcatttgtgtgtgtgcgtgtatgtgggtgtgtgtgtgggtgggtgtgggagggtgggaggatgggttggagtacactcaaaccagggcagtatgtgtgtattctgtatagttgctcatggttccagagatatttgggctttagccaagtgttcagccttatgctattgacaatctctacctgtaacagcaaaaaaagataatttgacatttgacactgggtgagtcctgtgtcctcatgcttaagtacagtttcatgactgacacagcagaatcccaattaagatgttttgagaaatagggttttctggtgtccttggttctaagcagaaaaccccgtatgtttatgtggatgccactgttggtttcaaacctcagtggtgaaacccccctcaccagtatattaatacattttcttgcttaaaggtactgagggtgacagatcttttaaagagaattctgtgtcttgtttagaatcttggggacatgaatattcgtttttatcatgtaggtctctaggggtagaagataaaggataatgtgtctaaatctgtattatgcataggtcgtattctccaaagagaagcttgtgctgtacaattgagttaattaaggagtccaattgattggattccctctggttaattgaagttttcctattctttaagttacaatgttgaaagggcttccaggtttaaactgggcataatgtacatgccagtcatttgcagaggcaagccccaatttctgggtgcttatgccatactggttgcatggggactttgggctcattctgtaacattcttaaatcctgcctaatggtctctacttaattttgtggatgaagctcttgcagcagattcattgaaggcaagttcagttaaagactcttcctcttccttcttttgccatcatttgctccctcctcccccctctcttgtttttctctccccttctcttctctcattcactgtcaggaaagactacctttgaagggacaattctgtaccgagctgcaccgggaaagacggagggccacagacgctattacagtgagtgaccttaacagcagaaggcaattgtaaagataagatctgggtacttgtgttttttgatgcagctgccctttcctgagctgctcatgcttatgccaagtgtctgtgtgaatttctgatccaaggacatggacttatttgtctaagtaagtgccatctccttggtgtgtgctaagaagcattcccagcaccagcccctggcgcttttgtttgctttctgcctctatcatgtatgtgatatgcgtgcatgagccatacgtgcaaacaaaggagcagtagcatttgtcgtggcatatgtatttgtaccagtttctctgggcttctggggtggtgtaagatggcttcctgcagagatgtcaacctctcatggttattgctttctctgagtgggtcactggaaaccaataaaccattttgtcattgtgtggttcaaagaagtaagaatttggcatgaaagtccatgccagaaatggcattttgctttgctcactcagccaatcaccacatggcagactttttttggcaggaccaatgtgtagccttttgtgttgtgaaataaggctgccaaaagttgaggggaaggagatgaatgagatgcccttagaacagttcttgccacacagtgagctccatccatgtgagtgttaaattaaaaatagataaaaatatctcatggatctcaactgatcaatgctggaagactgggtacattccacaaaattggacagttaaaggactctcagaaacaaaactgaggaggctttgttcttttttttcaccttgaaggaaaagcatccacctttgtgtgcatatacacatatgcatacatacctacgtgtatggatatgatgagagagaacgttgaaacatgaacaccagagccatgcttcacaaactggggtcaagttttttttccttgccactccaccatgggaagatgcatggccctactgcacatgacctcactacacatgcagggtgccgcctgtgcctcaccgtgggagttttgacagcacctagattgctctgtgccctggtcatttagatgactccaccaccagccacatgtctggaagttacaccagtgcacactgttaaaacactaaagcatcgccccagacaccacactttctgtagttctctcaccactgcctacctgtaatgagcccttcatgaaccagcccccgtccacagtccacactctgggttgcaccacccaagagtgtaacctggcattctgggcctgacatggggacattttatgggataatgtgcatgatgggcacgagtcactaaaagatatatcactaaatgaacatgaaaatgaaaagtcacctttctttccctctaaagggaaggaactagattttgaattattttaccaacacagatagttagatatttaatttatacacttaaaagtgatagaaccagcctgccagaagttctggaagaaaaatctgctgtgtgtttccttcccgggccatgcttgtgtggttgaatgactgtgcaacctctctctgtgtaacgtagagtatttctcacggtgattagtataaacatattaagatgagcccagaagacagtaaatcccaaaaaccagaagctcagtgaaatgaggatggcagtggctgaaaatattatggttctagctaatggtgaatgatagaagaacccttgaaattcttctctttgaaaaactaaaatagacttgccctaatctgtttgccctgctgccttctggtggtgatgaggggagcgtgctgagggaggggagtggtgatggtttctttccactaatggtttctttatttcacccttgaatggctctttccaagccagaaaggaatatacaagtcatttatcacatagaaagaatccatacggcaaaatgagaacatgttaagggggaaatgacacaatatttagactccaaaattatatctccagcagggatatttgcaaaaacaatgaacagataaacacacaaatggatagatggatagctaatgggggagggttcttgatgtttacacactctaatccttcctgtgaattgcagccgacccccttgttgtgggctgttccccattcggtcctgtgtttttgctcacaaatgctggttttcagttaattaaaatgtacactggggaccttcctcctcccccacccttttggcttaaaaataccattttatggaaaatgacaacaacaacaaacaaaaccattgttttaaggatttgattctgaaacgtgttagcagtttataatgacctttctatattttgtctgttttcatttaacagtttcttcctgcactgagacttccttatttgaatgacttccacattttatgagattttatgtgagcaagtatttggtgtatcattcttatggactaggaggccaccttacctgtaggaagataatgcacaattggctaatagagaacaacatttgatggcgtactttcatttcaagggcatggttatgatcaggagttatgtagtaaatgttcaggagctattctacacatctagaggctttcagagacaggttaatgacagagtttagtattccataaaatattctttgaatcctgccctttgatggcataattgatatactgaccatcaaaggaagaatacacccagaaattaactagacacaaataggctcttccttttaggaacatgattgtgggcagagccttgggaaaaaagaatctggggaggtaagtgtccatgttgtcttgctaataactattttatgacttccaaacacatgccacagaagatcaaaggaagagtgtcatgtccccagtgttcttctttggaaagggattcagctttgggaaaacactggtgtttaaaggagagaagaagggctgtaggtttgggggattctggcctctgggaggacggcttcctttccctctttaacaaacatgatcgtcttgctagtgaaaccgtcttaatgtcaagtttggtttaatgctttcctagagaaacatgtctgcatgcatttattccttgtgaagccatccaaaaagattgaattctttggcagttataattttgtgtggtttctttaattgctcatttgtttaaatggcttttagctttacagtttccctttaggaaatgttactttcattgctaattgctaattgacatgagtcatagagattggaggtacagtatgtggtactgactgggtggggaggcaacaaggtgggtgggaagggttgctattgcacaggctatgggaaaacaaatttggatcaaaaccaggctcccggctaaagaggggtgaatttcacatgtacaaagatatctgctttggaattagattttctgaaaagttgttttgattcacatcttaaaattaaaagtaaggggtggggagatcaaacaaaactcagagccagtcaaactactcaacatactgaatacaaaagcctagtgcaagttatcctgtgcccagtcacacttttagaggtggttcctggctggttgtgaagttcttcttcagggctctggctgatttctgagctctttctctccccatccccactcttgacaggtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaaggtatgttcgacagtttctatttgatttcaacttaatgtggaatatccaaaagtacgttgtggggtttggtgctggaggcttccaattcctcttttagggtttccatgtcctcatgtactagttgtttgtcctgtcttcttttttagctctccctctgtgtgggaacgacttccctcaaaaggctcatgctctagtttgctgctttctttcttgctgatctctctagggaatgcttctcaggatgactttggaaatggaccagtacttctctatctgcttcccagaaaaacccctcattcctggacccgcctaagtgcatgaccctgacacttttcagacactggccaatctctctccgctccttgtacatttctctagtgctttgtgcttgggtgtgctgactgtggttctgcactagagtgaaggaattgtgcaccttttctctaagagttagttggagataatttcagactgttgaaaggaagtctcccgcaggtgtgaatgatggagatggcctgtgctgtgactccctgggttgttcccttcaggaagctggctgtttccttctgcctctggttctgggctagtgagaggcaggcagcatgttgctgctgagtacgcggttaccacagcaacacacccagagccctcgcgcttgtggctgccgatgacgtctactgtggtatacttctgagcattgtagccttgcttaggagttgataaatactgtggaattttccaaattataataagctactctcgtgctgtgcttaaggcatgtttgttaattcgatttagtgctgaaatttttgctttgacatttgtgccagcagatttgggggacggggtattggcaacctctctaattcaggtttatgggtggcttttaagtgttgttgtttttttttctttctttttttttttttttggtgggataacattttaaaggttgcatcatcttctgcagctgtaggacatccacccctccacccgccctcagcaaccttgcccagtgtcatcatgcattagaagcagaatctgaaaaggaaacttttcgaacactgaatccctctagagatgagtcaggcagaaagggcagatacctagaaattaaaaaccgtttcatttaaactttttttttcaatgttgaagtttctttgagtcagcattgttcctttcagcaatcaatatatgatatttttcaagatctgaaaactagtgtcccagctcttgagctcacttctgttgcatatggtcacattcagattcctgtgaacatttacaaaagagcaagtccccatcttggaaaggaacactggatgcagtttttcttcttttattcaagtggttgaagtgaaaacgaccattgactcagtcagcaaacagttcattccttttgtttgttttatgattcctggcctttatcttctttgtgtaggaggactgtgtgtgtgtgtgtgtgtgtgtgtgtgtgtgtgtgtgtgtgtgtatgactcttattattgctattaatattagttttagctgccaataataaattgagttactgttgatagcaatgtcaatgtcaaatataatacttgaaagtttttatctcagcacatttctttcctgaacctcagagctgtatgtccaactgcctgcttacttcagtatctccacttgaagatcttaaattcatatccgtttgcctaaacctgaactcatcgtcctcctccaactgctctacccacagctttccccatctcagttgaaggcagcgccatctcccactcctatcgctcaggacagaaaccctcaggttgtccctggctctttctctcagctctgcctcctaaatatgtccatcatccacctaggtctcatcacttccactgctccttaatagggatttctgcctctccccatccccctggagtttagtcttaagagcgaagccagggagaacctttgaaaacccaagtcacatcatgctactcatctgctcacacccctaccaaggctttcctgagaaaaaaagtgagacccgaccctcgttactgctgggacttcctcccccactgctctcccttcactttcttcgttctgggtccttgctcttcctcagacatgccatgcacactcctacagggggcatttgctgcaatggtctcctcagcctgggccactctgcatctacctgcccacttggctgcctccctttcctccctgctatcttagcagaaacctcaccccatcccccttcctggtactaaatattttgttctctgtggcacataccatcttctaacagatttatttttgttatatatgtcacttattttgtttgctaatctattctatgtgcttagaacagtgcatggcacattgtaggtgctcaataaatattgttgaatgaataatattaaaatataaatgctgcactttagagattacagacatctctagaatgagagtattgggtgagataatatagcacttgtgtagttgaaaatatatcaattgtatagttcactgcacctctgtgaagcagatagttcatttattgcattgatattggtgccatgaagtgttaacttcatcagacacatatatgtgtgtgcgcaagtgcgttgaacatccctaatccaaaatccaaaatgctacaaaatcgaaacttattgggcaccaatatgattctcaaagtaaatgttcatcggagcattttggatttcggatttttggattagggatgctcaacctggatgcattctgctgatactccacaatgcaaaaagaaaaaaaaaaatctgaaatccaaaacacttctggtcccaagcatttcagatagggatatttgacatttgtgtgtgtgtacgcattcgtgtatgcatcttgattcctgatttgtctgcagaatgaaaccatgtgctggaagctccctaaacccatttctcatgtggagcctctggggaaaacataaacttcctagcctgctttctgggtgtggacaatttttacaacatctaagaggatttgaaactatctccaccccatgttgttggcgccatggatagttgcatagatttatggatctatcatgttattgtacaacctggcacaaaagccgataagtgtgattctgttttattagcatacaacctggttttcatcacttttgagatggttatgtgtctaagatttatgtctaaggaagaaagcttcctttgagaattgagctcactgttttcatttttagaagtgtaaattggatcttgcgtgatagcattcagtaggtgaggctcaagtaggtctgctcaggctgcgacagttggccttctgaaatgtctggcttgataacttggatgagggaaaaagggaatctgaccattattaacagctgtgagcatcatattatacttttcgttcaggtttgtgaagttttttttttttttttttttttgaaacaagagtcttgctctgttgcctaggctggagtgcagtggcacaatcttggctcacagcaacctctgcctcccaggttcaagtgattctcatgcctcagtctcctaagtagctgggattacaggtgcacaccaccacacccagcttaatttttttttgtatttttagtagagacggggtttcaccacgttgaccaggctggtcttgaactcctgacctcaagtgatccgcccaccttggcctcccaaagtgctgggattacaggtttgagccaccatacctggccaagtttgtgaaatattaagatccacttgtctgagtcagtagataatcttgtgcttatcttatattttaatctatattaccctacccagagttaatgattagattatacaccaggagagatattgtataacatccctccaccaactgtgaatagataaatagttcatgtaggtattcttgtttctcttatcaggctataaggaaggattccgtttatgaatcttttaaataccaccaagtggatatgtctccgaatgatttgctgaatgtaccatttaactgaaatatttacagctgagttgatttaatgtctgggacttgcttcctatagtccagaagatgaaagagtggggcatagaggagacattgatcatgagttggtatttgttgaaactggatggtgtatacatgggggttcatcacactctatttttgtgtatgttggaaatttcccttgataaaaggttaaaggggggtggggaagaaccttggagaaacatgtaccatttaaaccaagctcagatgtaagtatgtgctgtatcaaaataatggaaaatgctatatggctatagatgaaccaggttacaccttagaaaatcatagggccatagtaccttcatcctagctgattgacctcgatgaagttggcctcagctgggccatctgtaaaatgggaatacttttttttacctatcttacctcacaggacttaaaaaatatatacctgaaaatactttctaaatatgactcatttcaactagcatgtattgagtgctcactaaatatgctcagtactgaggatacagtcgtgagggagaccaggtcactgccctcagggagctacagaaaagtaaataaacaataataatagagtataggaaatgccataatcaggctgagaacacagtgttgtgctgtaggagccctcaggcatggcaggaagtggtaagttgttagggaggctggaaggtgtgtgtccgttcatgtgtgtgtgtaccagcttcctacaggaagtgatgtttaggctgaaaaccatgggtccagtaggcgtagagttattaaggtagggagagcaatatctataaatgccctgaagagggaaagagatagcacagatgatgtgtagaggctccagcaggaagcggggaaagaagcagggcccagatcatgaagagtcttgtgagactcgttagggagttggacttgatcttgagagcaatgggaaactatcaaagtgttttaagcaagagagtgacacgatcagataggtggtttagcgaaagtattccaactgcagtgtggggagtggattacagaagacagggtgagtaaaattcagaagagaggtaacagaaacatactggctttcctgataaatagccccccactccaaatctaggttctaaaccagttaattaattagatgagtgagtgaatggataatcaaaatattttgctgatttttttttcattatagatatccagttgacccagcactgtttattgaaaagattatcctttctacactgcacagccctatcaccttagtcataacctaagtggctatatataagtgggcctatttctggactctgttctgttggtctttttttccttgtgcccattctatgctgcctatgtattcctcttcaagattacctaagctgttcttggccctttgcattttaatttaaattttagaatcagtttgtcaatcccccatcatcataaaaaaaaaaaaaaacctcctggaattttgattgagattgcattgaatctatagacacttttgatgacaattggtacctttctaattcatgaacatggtatatccctctatttgtatagattatgttttattttgtgaaatgttctcaagctgaacacttatgatttgtgatctctctgtgcatacgttttatttcagtgtcattactgatgaaggcaaagttggaaggtatagattagtgtgagaggcaaatgggcctgccagctgattcccagaattagacagatttgcccacacaatctcagcaacattggactaactcaggccaatgtgagatagaaagacctgccccttgaggaacagcagagaaggctgacttccaagaggaggaaagagaagagctaagctgagcacgcccagtatatttttcttaaattcacctatcagataagtaatttcactctcccagggaaggaaacataaaggggaagagaacggcaggagtgtctaattgtgtccagagagtgtccatttgaatttctttacatagaaggggacatcaaggtaagggatgtattaacagcttgaactattgtcatggagagaaatggatggtttggggaaatattttgaagatagaatcaagtttgatagtatgtgggggataaagaagagggaggacttgaagattgtgccttcggcaactggcttaagcagctgagtactattttctgattagaaaacagtggagagagaagatatttggggaggaaggacatgggttagactagctggatttggaagttcttgtgggactgtatcaagtagagacatccagcaggcagatggatacataagtctggtgattgggagagaactgtaaatgtaggtttcagagtcatcagcctagagattgggctggaagactctgagcaagaaggcaagcccagacgagactgtattctcatgaatacaggtggtacctctgtctcccacctgtggacctgagagggaatttcttcatcaggctattttcctgtgaccccagtctggccctactctctgtttctaaactccttccctttttatgagtcacttagatgatcacttctgaccaaccacttagggaaaggagtgtcaggtattacacatggataggtaagttacagatactcgagtgagtctcaggacctaacctgacatggctttatatagaataatgctgggtttttggtgccagctcattccgtgtcctagctctttaggcactaccagtcttggcccacttaattattggaaaaagtagtcttttttgccttactggaaagatttctaaactgaatggtttgccaggttggttgtttactggattccctgcggagaaatctttcaagaagcttctttcccatggtcttcctgtcttagctgatttccgttagtgacttctgacatctctctcttgaattctgtctacactttctacaaggcgttgtgtttgtaacagcctctttttcaactcttgtcatcttgaatctcatttatagaattatagtcacccaaattaatgcctttatggtatccacattgtagcttttacttgggacagataattagaattaaaattgtgtataaatgagagtgactaatcaagtttttaattagccaaattacagtaagagaatttaagtattttcatacgtatctcaggtagtctttttttttgtatttaatttttgtgggtacataataggtgtatttatgtggcacatgagatgttttgatacaggcatgcactgtgaaataagcacatcatggagaatggggtatccatcccctcaagcatttatccgttgagttataaacaataaaattatactctttaagttattttaaaatgtgcaattattattgactatagtaatcctgttgtgctaccaaacagtaggtcttattcattctttctattttttatgtacgcattaaccatccccgcctcccacccagcccccacccaggtagtctttttatccattctagtaaaaatttattaagctgcataatcatataaaattaaaacatgtcaataaggtgatgatcttagttccttaaaaatgagagatctatgtcctaatcctttgaagactagaaataagctctagagaactccagaagctaatgagatatatactctttgactaattaaacacaagggtcaaaaccttgttgtgattatctgagacctagagtattggctgtccctcgttttggttgaaaaataagattgtgtctcttgagttgttggaaaacctgtggtttttaatgagcagatggtattaagatgcccactggttgcctgggttgaatgaagtgtttgggattttcagactttggcttctctctcctcagagtgtctcagttttgtttcctgatctggaaaaagtaaggaaggaggaggggagttggtagggaaagggaaacagaaacagtgaaccagtattacaggattattctttgtcatgttgggtgctgctttctgttttatatatgtttgatgtgaactttctaaaacactcagcctagcgtattttctaagaaatatttagttgcagccagattgtcaccaagaatcatattcccagaaggttttcaaattgtgttaagagtatagtggttggccgggtgtggtggctcacgcctataatcccagccaaggcaggtggatcatgagttcaggaaatggagaccatcctggctaacactgtgaaacccagtctctactaaaaattcaaaaaattagctgggcatggtagcatgcgcctgtagtcccagctacttggaagcctgaggcaggagaatcgcttgaacccgggaggtggaggttgcaatgagctgagattgcgccactgtactccagcctgggcgacagagcgagactctggaaaaaaaaaaaaaaaagtatagtggttattaaacatggaggacagatagcccaggttcagacttcaactctgcctcttcctgggacaagttacttaaccactcagtgcttttgattcctcatctgtaaaattagagtaacaagagaatctaccccagagggttgttgtgaggattaagtaacatgtaatggttagagaagtgcctggcacatagtaatcacttgattaacgttagttattattattgttgtccttattgttattagagtagaaagagtacctataaatgacagtacattttccagggttatttctatttatttatttatttatttatttatttatttgaggcagggtcttgctctgtcacccaggctggagtgcagtggcatgatcttggctcactgcaacctctgcctcccgggttcaagcaattcttctgcctcagcctcccgagtagctgggattataggtgtgggccaccacgcccggctgatttttgtatttttagtagagacggggtttcaccatgttggccaggctggtcttgaactcctgacctccggtgatccacctccctcagccttccaaagtgctgggattacaggcatgagccaccatgcctggcctctttaattttttattatggcaaatttcaaactgcaagaagtacaattgaattttgctatatctgtgttagctgtttgtttcatatcaccaagtcttaaatgtcagccactagaaagtaagtgccataatttgggaccttgtctgtgttagtcaccatttacagtttatgaaaatagttgtcaaatgatagttggccctcagtaaatatttgtggactggatgaatgaagatactgttttgtgctaatccaattctggttgggatctgcttgtggtctagctaagattcactcttccatttgttcattaattcactcattcattcattcactgaagctttattgaatgccttttatggatcagcagtgtgaagctttattgaatgccttttatggattagcagtggtatctctgggatttgtatgtaaatgaacaaaggggtggcaatccatttggaaagggattggctaaatggcatgtctagatgttgtatttgcatagtaagtgcggtttttttttaacctgacaggttatttatttggggtggagcagatctggtgtggttcatcggaatggagttaacacctcctaccctaagtcacaccttggatcagctgtcatatacaggtttctcatttaatgctttggattgtccctacattggagagaaagggggtatgtataaaagtcattataatgtaaggggaaagactagcagacgcatgtccaaagcatcaatgagaatagaaaggaagaaactactaactttcctccaggtcaagaaggaagggatgggatatccttggtctctttttaaggaatgtggtatttgagcaaggtgttaaaagacgttgggaattcatggtactagcagtgtgcatgtggacaaggagtgagcatgagtatgttgaaggaagaggtgggttgggctggggtgcaggggctgtggtggtggtagtggaggaagtgggcagctgaaggggaggtggtgcctcttcctgcagggctctgccagcccactcacaagctgcccttcttctgggtgggtgggcaagttggtgaaggagttcagttgggcagcagcatgatcagatttatactttagagagataactggggaggtgctgaggaatgtggactggagatgggagaggaagtagctgggagacttgccagccccggggctccatggtcgatgactaattggccaggcaccaggaacttctagtagctcttggaaaggggcagatgggcccacctcatgcacactctttaagctggatcgccgttgcctgggttggcagcaacactgacaaaagagccaagtttcctttcaaagaaaattcttttgtgtattttgggaatgaaaaagccaggagtcagcattctactatcttcattaatagataggctaagaagatagagacaatttttaaatttgaagttgagagggccttgttaaatagatttacatagatatacacatgggcataaacatgtatagctataaatcacagatatgtgtttatttatatatacctttgcattcagcaggtttatctttctaattagttttttaatcaacttttaattttagagtagttttagatttatggaaaagttgtgaagataatagagttcccacatacctcacacccggcttcctctcttgttaacgtcttgcattaacgtggtacgtttcatattatctttttttttttttttttttttgagacagaatcttgctctgttgcccaggctggagtgcagtggcgccatctcggctcactgcaacctccgccccccacccccacccgattcaagcaattcttctgcctcagcctcctgagtagctgggattacaggcacctgccaccaggcctggctaatttttgtatttttagtagagacgaggtttcaccatgttggccaggctggtcttgaactcctgacctcaagtaatccgcacaccttggcctcccaaagtgctaggattacaggcgtgagccaccatgcctggcccatattatcattattgactaacatccatgctttattcagatgtcctcagtttttatccagtgtcctttttctgttgcaggatcccatccagaataccacatttagttttctcatcttgttaggctttaacagtttcccagactttctttatttttgatgaccatggcaattttcagttttgtagaatgtccttaaataagcatttgtctgaagttattctcatgagtagattggagtcgtgggtttttgggaggaaggccacagaggtgaagtgctctcattacatcatattaattccatacttatcgctatagatgttaaccttagtcaccttggctgacgtaggtgttagtcaggtttctccgctcgaaagttctggttttttccctctttccatacttgactctttggaaaaagggtactctgtgcccctcccacttaaagagtggggagtttcattctacctccttgagggaggagtatctaaagaaatgatttggaatccttctacacaggagatttgtttattctcctccgtcctagttgggttttgataagggaattttttttatctgttctctgaattccaaatgctaattctgtagcacttgtattatatttgtcatttactacctagtgacatcacctacatttgtgtgtgtgtgtgataagtaaacagatttatgtcttatttacccaaggagattgtaaatttcttgaggactgggacagcatcttatttaaagccccttacagagttagatacagtgcaggcagttaataaatagtaagcaaatggtttttaaattagtttaattaaaaatttaaatattaaccatagttaactgaaacaggtcatcaaagtctaagcatatgagaaatgtggtaagataaggatactgtttacttggcatcctgatttgtgaaattgtcctgaacttgtaattgtggctaatatgatatttactgtgtgccaagcacttttgtaagtactttacatatattatttaattttccagacagccctgtaggttggtgccattatccccattttatagataaggaaactgagatgaacaaaggttgaataagttgttcaggatcacaaagccaggaagtagctcaactgggattttgatctcaaacactccggctccagagttttgaacacttaaccactgcgctctagattcattgaagtggtgattaaaatggtatctcttttgggggaaagaacaaaattgtgatttaaatatttcatttcaacctgttaggatgctcctgatgacatggcagcaatgttgctgtatttttcctagggggagtatttccataaagccacggctgtttttccttcttctgtgtgtgtgtgtgtgtatgtgtgtgtgtgtgtgtgtgtgtgtttatgagtaatttttgtgtagtgcaactaattgcatttaaaatacaggcatgttcatgattgatatgtcatatacagactatattctagatatccctcactctctagccatgtgatctgttgaaagatagtgggctttttatttcttctctggcatttttaaacagacgtgatcactaggtcttgccaaataaacactccctcagtgtgttccttgtccgaatggtcacacctgggggccccaggagggagcccagattgcagcagcaacataggcgagggaggaggacttctctcgaagccacccaagccatgaattggccctggcttcctgaaccataaacaaatgcgagctttgttctccccattcctcatttggtcccaagtatgactcagggttaggctgggtcctcaggctccgtgctgttggaaggaagtgggaggattccaggggagttctgggaccttttcaaactgaagagaggaggctggctgcatcatgggagaagaggtatttctttttttttttttttgcttttagagttgtaataaatccagttaacctgtatcttatctgtatataacattttgtagcaagactgggtaatgggtttgcattagtgggttgaaacaatgtgtgtgccagctaggatcccacagaggggagctatggataagctgaggaggaacctatcaagtatacggattatttgctaaagctgaatgtcactctggagctatttagccgttttaatccctcccactttggtcaatttggccattaatttttacagatgtttccaatctctctgtgtcttgggttttcatgtgctcatattgcagagagaaatttagatgggcagtttgcacaagcggtaactgttacaccatgtcacagagatgtttagcaattacagatgtttgtgcagtaaacaaatccagcttgcttttcaggttagcttagagagaagggtatgtccatgcagagcaagccagctgtggggcgtttcactcttgagggtcaccgacatttggagttttctttgtgagtggagcagctgtgagtagtgacttctgggtgctattgaactgctttttttatgatggggtaaagatatttggctagttttgtagtgcggggcatttataggtatgtactcatgtatggagaaaaattaagacactaaattattttgattttataaaagtttgctagaaataagtggtcttgtttttctctgtgagttgttcatatttgtctacctaaaagcagaagtctgtcattttccaaacacaaaattccctaaataaaccacaggataagtaaggcttacagtgtgtcatatgtcttccatatccctgtctctcattgaaaaaaaaattttaaggggagaattgatgaggtctgtaaaatatgtccctttatgtctttttctgttggctttaacttatactattttcaaaattacaaaaaaaaaaaaatagcgtggccaaaaggaaacacattgttttaacatatcattttaagagtaggggaacttcttgaaaggtttttaaatggcatctgttgcttgcctagaaaggaggacagaggcagatatatgaggagagtgccgttaggggttggctaggataaaaatatattcatcggcaatggcttgagaggattttcctagggaaagatagcttatgtttgctgatcttatgctggatgtctttgttctgagttctgatgagtagaaatctgaatgaggtatttatatgcaaaataaagatggtgaatcttcttccttggggaaatgagtgaaagcatgattgattgtaaggtgtgaaaaacgtgggaaagtctcagcagctagggcctggagatgggagaggaatggtagcccctggggggcctgacaggttttgccttggtcctgtgatgtctgagctacttgttgcactggtaagtgctccctgaaccctttgcttgtttgtttctcaaaatggaggtagctctgttacttctctcattacaagagctctttgtaataataataataattattattattattattattcaaagttgaagaatacaaagaaataaatagaaatcatcctcagctgagtgcagtggctaatgcttgtaatcccagcactttgggaggctgaggcagttggatcacttgaggtcaggagtttgagactagcctcggcaacatggcaaaaccccaactctacgaaaaatacaaaaattagctgggtgtggtggcatgcacacctgtagtccccagctactcgggaggctgaggtgggaggatcgcctgagcccgggaggttgaggctgcagtgagctgagatcgtgtcactgcactccagcctgggtgacagagtgacagcctgtctcaaaaaatatatatatatatatatatatatatatatatatatatattaccctcaatcctatcattcaggaacaaccatagttaacattttatatgtatccttccagacttttttttttttttttttttgagacacagtctcaccctgtcgcccaggctggctggagtgcagtgacgtaatcttggctcactgcaacctctgcctcccaggttcaagcgattctcctgcctcagcctcctgagtagctgggactacaggcgcccaccaccatgcccggctaatttttgtatttttagtagggatggggtttcaccatgttggccaggctggtctcaaactcgtgacctcagatgatccacctaccttggcctcccaaagtgctgggattacaggcataagccaccacacctgacctcttccagacttttttttgagcctgaatatgcatgcagtacacacatcactcttcactaaataatgaagtcatatcaaatgttgcctgtttttaaaaactttctatgagacccctttttctatcaggtagcctcatgatttccctcgattctcctgcctcagcctcctgagtagctgggactataggcgcccgccaccacacctggctaatttttgtatttttagtagggatgggatttcaccatgttggccaggctggtctcgaactcctgacctcagttgatccacccgccttggcctcccaaagtgctgggattacaggcatgagccaccgcacccagcctcttccagacttttttttgagcctgaatatgcatgcagtacacacatcactcttcattaaatgatgaagttatatcaaatgttgcctgtttttaaaaacttaatgtactatgggaccccttcttctgtcagatagcctcatgatatccctagggtctctgtccgttgtagagatgcagcaccatttgttgaaacaatctcccaaggataactatttaagttgctcccccatttttaacattacaaacaacattcttgtaaatccatcgttgtttcttccctgattatttccttaggctgaatttttaaaagaggaatttctaggttaaaggtcgacttaattctggctagttttgtttttaatgaaaataattcaagtatacggtaaaaaaaaaaaaaaaaaaaaaaaaaaatcccaacagaacaaaagtaagactttctgaatcctatacacttaactttacttcctggtggaaatcaccataaaagttatatgcactcttgcagatatgtggaattggttttttattgttgtaaaatatatttaacatcataaattttactgcctttgccattttatgctttgctttgttttttgagacagagtctcactctgtcacccaggctggagtgcagtggtgtgatcacagctcactgcagtcttgacctcctgggctcaagtgatcctcctgcctcagcctcccaagtagctgggagtgcagacatgagccaccatgcctagctgactttttttattccttttgtagagacagggtcttactatgttgcccccagacaggttttgaactcctagcctcaaagaattctctcacctcagccttccaaagtgctgggattacaggcatgagccactgtgcctagccaccttaaccatttttaagtgtgtagttcagtgatattaagtacattcatatatttgtgcaaccgtcatcactatccatctccagaactttttcatcttgcaaaaatgaaactccatacccattaaacaataacctcccatgcctcctacccctgaccccggcagctactgttctactttctgtctctatgaatttgactaggtacttcacatatgtggattcgtggggatatttattgtcctcttatgactgacttatttcacttaccatgatgtcttcaaagttccttcatgttgtggcacatatcagaatttctttcgtttttaaggctgagtattatttcattctatggatataatgcattttgtttatctattcatctgttgatggacatttgggttttttctatcttttggctgttgtgaataatgctacaatgtacattggcataccaatacttgtttgagtccttgctttcaattttttagatatatctccagaagtagaattgctggatcatagggcaactccgatttaaatttttgggggaactgccctactgttttctacagtggctgcattgtttcactcggtggaagtctcagcaatgcatgagagttccaatttctccatgtcctcacttgttattttctgtttgcttttttttcttcttgtagccatcctaatgggtgtgaagtggtatctcattgcaattagagttggtgttcatgttgcctgtcactgagggggaaggaaattattattattctcatcttgaaatgatgagttgggaaatagtcttagaatcaccattaactagctgatcagtcatgtaatctgaagagactacaaatcgcttaaaggaagaacacagccccactgttcccatagccccaaagaaaaaaatgagtggagtgcccaggtagttacttggtttcagaggtttaatggtgaccaggactggcttttcatgttgccccatccgcttacctgaatctatagtcaaaggtttgttggagagtagatttaaaacagttctctcgaaaaaagatgaatttatcttttgtgcaactgttattaataattctaagcgatggtatcttattcatcttacgtagtggataaagctagttttgtgattgattttttttttcctcttcaccttctactctggaattccttaggggtagaaaatgaaagtccttttttttttttttacaaattatttgctgaatcgtttatttaatgattcagttggtagcctttagtggagtgtactaaagtctaagtatttaattgtgaccctcttttgttctttacttgtattaataattgttttcataatatttatatcctgaagtatgcagatgcatttggttcctgaaatccagttttaaaaatttggccattaaaactatcatgtctttgtacgtagctgtctttttctctctgatattctcactagttgtaaaatgatattctagccaactggctttcagtgggatggaatgagtttaatgctatgtaaaaactggcaactttaaaagaagctatccagcttactttgactgcatggtggtgtgtcttttcttacacttaaagcatttagatcacagagatcagtcagtcagcagcctgttttgtacttctctgtggcattggaggccatttaaaagctacaggatgacagccttattcccagctcaggctcttaatgttggaggctagatcccaaataaatgtatagccataaatgctctagaaacaaatggaaacatcacaataagctatacttacacctctaatagatatttttctctctctctaaacccgggctataaaatgagcaattcacaaaataaaagtgtgctggaattgcctctaaaagacacttctttatcaaaaggccatcctcaagccattttacgaatgccctgtgactcagaagtgtcacctcaattaaagttatccttgaactcttaggaatcaaataggcatggtttggcaaagtgaaggcagaaagttgaggtctgtatcactcagaagttgtatttctgttttgtcatttaaaatgaggaaggtagaaatgctaaagatggatttactgcctcattttctttttcttcttttacttgctaagaattttcacccaccagtgactttaatatgttttgctccatttgttttggtaacgtctgctcagtctgttctttttattttgaattcttagttgggttctcattgtctctctctattagaagcagcttttctggaacttcttgggtaacttttctagattattcacaaagtcgataacaagaggagtagtgatgtaaaaagtgtcaatatttttagatcctagagtcgtgcaaaactgtcctcttgatgcagtgcttagcattgtctagttactacattggaagaacaagatgccttgtatattttacgtgtctaatcatatattcatcttgcctcaaacccctttactccctttacattcaggcattgttagaagctgagaaagtagacatacaatactgttgttttttcaattcagaagaggctaaaacattatgaagctggtaactctatgcccacacatggaagtaatctgcctgagcaatacctgtcacaatatcaacatgcagtagaggtgagcagaatgtaattcatggacaaccttgctgtactttccagtgaagggttataggatctgtgacattttggtattattttcgtacgcagtgcccaaaatttcaaacaactctaggtttctatgacctttagtcataggtcatctggcaggagaagagaaaagtggtctggataagagatgaaaaggggtcttgagaaaattaatgagaggctgaaagagatacagctgggtcagggagtgatcactaagtttccaagtaataaaattcattctatggggccatagagcagcagtgtgtttgtgtgtagcccaaccctgacttttccatatcagttgaagactggcagttgatcatcttggcatgaaattgagtggctagaaagaagtaagggtatcctagggcatgatgatataaggcagtgaagatggttaagaaattagaaatcaggagtggtagagaaacagtggtcgttgcagtagagagagacaagtaaacggagtccatgaggagatatattatgtaggatttgacagttgactgttctgtggtctctctggtgactgagaaagaggcgtcccattgattgattgattgagagagggtcttgctttgttgcccaggttagagggcactgacatgatcatggctcattgcagcctcctcgacctcccaggcttaagccatcttctgcctcagcctcctgtatagctgggactacaggtgtgtgtgcaccaccatgcccagctaatttttaaattttttgtggagatgagtttttgccacattgttcaagctggtcttgaactcctggcgtcaggtggtcctcttgccttggcttcccaaaatgctaggattacaggcgtgagccactgtgcccagcagggagccccatttaacttgaagcatagtgatcagattgcaaataatggagaagtagccaataatgagagtcgataaactcttcgttgtcctatggggggagtatgtggaaatcttttactgaaagtccctataaatttgggtagataaccaaccgaaacctatatgtctgaaatagataaaatgtaatatctcaggagtagggaatgtgttgtcagttccaacagtaccattcctggtctttatcttcctttgtcaccatgttccgtgaatctctattgtgttttctctgtgcggagcctatagcaggtctttgtggaaggcacaaagaaggactgctgctctccggaacttataagtggagaacattgaaatgaacattctccattgtaatagaaaaggacaaggaatttctcaagaccagaaaaatgtatcaattgggatattttactgtgcacattgtctcccctactcttcctgaaaaaacaaaatatccctcttaaaaaataacaaccacgaaaagcaccatttaagaagcacgtgattaaaataggtgatttcatgttttgtttttttaaatgagggttttcttttgcattttgtgtggcttggtgcctttgtgtgtgttacagagaaagcagaaaataatggggaaatattttagtacaggaagatgagaacatgcaaaatgaataatgaaagacttaccatttattcagataatgaggatttaatttgcctaaaactcaggcatcttaaaagataacttacaaccttaagactcctgttcctcccaagacttgctgttaaactgaagttaaaatgaatggaagaatgaatgaatatgaatgacagccaagtatagactttattgaccttttgcttcaccagaccagaatttactctacaaaaaggttcatcttaactacatttactgaatctgtccccacctcaaacttgaatcccattaaaaaaaaaaaaaaaaagtcagtcctggtttttgaagtcagcaaaatcaaagtatgttcatgttaagtggagatgcttgtcaaatagctgagaaatgaaagtatctgtgaaatctgtataattttaaaattatgatatactgaagtaaatagttctaagagtaatagagaaaaaaagtggaacctcaaaagttggggagcctggtttttatcacacttgttttttctcccatttgagaaactgtaattactttgatttgtgtttcaaaagaatttttactcatgaagaactagagaactgctagaaaactgaacaattaagctatggatcctctgcaaatagatcacagcctttaaatcaatacttcttcaaatactgggagataaggaatctataagcattatccttgagcatatatgaaaaacgttacaaagtgaagttaactctttttttcagtcccttacagatgtatgaataaggaatccatgggtttaattagaagagcaggaaatatgtttttgaggttgaaaacctttgatacaatgtctcaatactttatttggaacagcatgaattggaaattacgtcatctactagtcactgaagatattaactgtgaaaaactataagtagtaaagggtgatgataaatggcagggaatattctatatgggtggtgtctttcgaattaccgtcatgactcattttacatctgatgttcttaacatccttactaataacttggagaaggaaatataatgacacacaagcgaaagttgcatatgatttctagttgggagatgttgcaaaccaaatcagaccttatggaaagacatcaataacgtggaggggtagaacatcatttttcgctacctcagtgtatgctattttcttagaactttattttttctggccaggcgcagtggctcacacctgtaatcccagcactttgggaggccaaggcaggtcgatcacctgaggtcaggagctcaagaccagcctggccaacatggtgaaaccctgtctctactaaaaatacaaaaattagctgggcgtggtggcgcatgcctgtaatcccagctactcaggaggctgaggcaggagaattgtttgaacccgggaggcggaggttgcagtgagccgagattgcgccactgcactccagcctgggcaacagagcgaaactccatctcaaaaaaaaaaaaaaaaacaacctttattttttctgattttaaaagtaataactagtttgtagaaacattaaaagtaaaaaaaaaaaaaaaaagtaaaaagctaaaaagaactgataatttaatcaccctggggcaatcactgttaactttttaaaatatttactttcagtccttttgccatacatttttaactggttgagatcataccacacacataattttttccacacacataactttgtatcttttccacttcgcattatatagaatttcccatgtcattacaaactttttgtaaacatctctttgaaaggctgtgtgtaatgctcagttttaaggctctagatacatagaggaccagatctgggagaactggaatttggtggttgtgtagattcccatcaatattatgtttaaatctaccatgttatagctgagaacgcaacattttctttacaatataaacataaaaataccgtgggaaagcagtttgggcttgtgggctgcattctgcaaaggcttgttgaattaatgtactccctataggatctgaacaggattccagttctcccttccttactaatcttgaaagaagcctttaagagaagcctttggcaggaggcctggccaattccaggtaaaggactatgaattcaacttttcatgtctaagattctggcagctatttccactagtggctttagaaatctgtactacatgagttgatggtctcatctggcccctgtttcttaactgcatcgggaggagtatctggcctggcaatttaggatttcttcatcccttattgaatggatgccaagctttgtaaaagatggcttggggtaattttctatggtggtgtgtttgctcctgagtatcaaaagtttcaataaaaggctttctgttctctgacaacagcccatttttcccagacacatgccttgttgtttttccatcattgacagtagataagtttggatgcagccaaaagcggttggcatggacccgcacttgaggggctcctgggatggtcttccagccactcactgtaggcaccaccttaactgatgccttcttgacctgaaagctctttgttccattagctttttcctcctcagcaatgacttctgtggtgatggctgttgctttccttctctttccatttttcagttatcgctttcctcccagcatgtctgtgctgtgtaattctcttgtaaaagttgcttcttgctcataagtccccaagcggaggaatggagcagttaacctgctgtttcaaaaagttgtaatcgaaaccatcattctctgtaactagaattcataaagaagcattatgaagatggagtttttaattcagtaaaattcaataacagtaataatagctaagcacgttacctacctagaaaacctatgagatgtatattgttatgtccatttcagaagtgaaaactgaggcacagagaggttaagtagcttccacaagattgcataactgtaagtcttcttaatactaattcagtcttaccactaggtgctgaaagtggcacgggtttattcattccattcttaggtccctagtgcctagataactcattgcactcaggccttgctccataaatctaaatattttgtgatagatgttgagtttcctgttgactgaagtaaattaagaatatttagcatctcctgtgcaaggcacatgggtagatacaaagattaccagaacccagtcctcctcctccagcatttatagtccagttgattcaacaggcacatagagaagcagccgtaaatataagacagaggacagtgaatgctgttttagagattcaaagtgagttcagtaggaacatgggggaggtgagagagaattccaacagttgacatctaggatattttcgtgaaaggcatacaatatgggtttacccctcattgttgaatatgtcttactaagtggtaactggagtgtcctgagtttaatttaatctgttttgggatctccattcttgaagcacctttgaatcatctttctaaatgttttgctatacatctagaagacgtatcaaatgtggaccttggctgggtgcagcggctcatgcctgtaatcccagcactttgggaggccgaggtgggaaggtctcttgtttaagcccaggagttggtgaccagcctgggcaacatagtgagaccctgtctctagaaaaaaaaattaaaaattagctgggcatgtggccgggcacagtggctcatgcttgtaatcctagcactttgggagaccaaggcgggcggatcacctgaggtcaggagttcgagaccagcctgaccaacacggtgaaaccctgtctctactaaaaatacagaaattagccaggcgtggtggcgggcacctgtattcccagctactcaggaggctgtgacaggagaatcacctgaacccgagaggcagaggttgcagtgagctgagattgtgccattgcactccagcctgggcgatgagagtgaaactccgtctcaaaaaaaaaaaaaaaaaaaaaattagctgggcatgatggtgtgtatctgtagtctcagctacttgagaggctcgcttgagcccaggaggtcaaggctgcggtgagctatgatggcaccaccgcactccagcctgggtgacagagcaagatcctgtctcctaaaaaaaaaaagtgtaccttacctctggctgtatttaggaagctccttttttgaataagtatgtggcttgaactcattatttctaataaaaacaaaatataaaaatgatatcattggccgggtgtggtggctcacgcctgtaatcccagcgctttaggaggccgaggcaggtggatcacgaggtcaggagttcgagagcagcctgaccattatggtgaaaccccatctctactaaaaatacaaaaattagccgggcgtggtggtggatgcctgcagctactcgggaggctgaggtacgggaatcacttgaacccaggaggcagaggttgcagtgagctgagatcgcgccactgcactccatcccgggtgacaatgcaagacaccatctcaaaaaagaaagaaagaaagaaagatatcattgagcctttttaagtaacctgatgtaatgttctctgccttttttctataaaatagaggagcccagaaaatggggaaaaaaaggaataaatgttattctttgggaatctgtggagcagatgatgaaagtaaagaatgagtcctaagatactaaagtcagagctatttagtgttagcgagatttagaggtagtctttatggaagcagtaggttatctttcagagccgtagaaggagtgtttcagataagaccgaggtgaatgaacacagcaggcatccctgagatggaaagcttctggaaaaagatgggtttgttctctgactcacctcattagatactgactacacccctgattattttgtggtcgaatcttaagtatcaggatatcacagcctcatgagcaacttttttttccacccattctaatcgacattcctggccagagagaggcttacaggaaaagaagaatatgtggtaaaatatacataacataagcagcttagccgtttttaagtgtgtagttcagtggctttaaggacattcacactgctgtgcaaccatcaccaccatccatctccagaactttttttatcttgcaaaattgaaactctatacccattgagctacccgcccccacccccagcccctggcaaccaccagtctactttctgcctctaattttgactactctaggtaccttatataaaagtgaaatcatacagtatttgtcttttttgtaagtggcttatttttactttaatgtcttctaggttcatgttgcagcatgtgtcagaatttctattattattattattattattattattttagatggagtctcgctctgttgccaggctggagtgcagtggtgtgatgtcgactcactgcaacctccgcctcccgggttcaagcgattctcctgcctcagcctcccgcgtagatgggattacaggtgcatgccaccatgcccagctaaattttgtattttttgtagagacagggtttcaccatgttggccaggttggtcttgatctcttgacctcatgatccacccacctcggcctcccaaagtgctgggattacaggcgtgagccaccatgcccggccaatttccttcctttttaaggctgaataatattcgattgtatgccctaagtcttttttttttttttttcgaggcaggatcttgctctgtcacccaggctggagtgcagtggcacgatcggggctcactgcaacctcaacttcctggctcaagcgatcttcccgcctcagccctccaagtagctgggactacaggtgtgcaccaccacatccagctaaattttttggaattttttagtagagataaggtcttactgtgttgcccaggctggcctccaactcctgagcttaagcaatcctcctgcctcagcctcccaaagtgttgggattacaggcataataagccttttaagtagcagttttttggttgaaaacaaaacaacaaaacactgttgcaggcatttacctcttttctgattgaaactattttgtttcccttctctactctgaaagacagaaaagctctggaaatttctgctggggaaagaaatttcccatttttgtcttcagctcaagacatttttggagacatttgactaaactgtttactttaaatttgtcagattagaaagatgctttttcatatgtgtcaggagtttctcacatgtctatgttttttaaaatgttttagttttcaaatggtagattgattggtgttttaacaggaagctaactgttcaaaatgattacaggcccattatttttccactaaacgtttcgacactagcatcagagcactgagagacacctgcactgtgatgcttcccattagggtatattctccacgatgcctccttgagccaccatatctgtctctctgactctctaactctctaaatcggagtctgaacttagtattgttgtttgcacttgattgacacccagtaactatgtggcatgcatatatgtggacttaagggcataatagaattggaaatttttccatcatagtcaaaccaattcaccaaaactgatttatccctgtagtgactgtaaactatgaactgcctttagataggcagcctaagtatctctcaaaccttaatttcatctttaattttactgccttaggtggattattgtgtcaacctccccattgtcttcttggcttttgcatgtccttgcttttcttcttcattcctcccaataccaccagatcatctgtcttaaattcacaaatttgattgggccatgcctctacttatttttcatcactactggttgcttttaagacaaagcaaaagcaaaaactgtaacattggccctaacttaccttgctggccttttgagcccaagcagctctccagtcacctcccttcaactcccactgcgaatccctgccaccctcgatcctgtgctgggaagtccccattccctgcacacatacctgccttgcctcctgcttttcttcagctagaatacccttcccaccagtctctacttggcaaaattttacccatcctttagaatttaatgcaagttgcatcattgctgtgaggcatattttcccatgaacgtttgttaatagctctttgttttcttgttctataggtgcctttatcgtagtgcttatccctttgtattgtgatgctctgttaatgattttgtctctgctgctatattctctttttaattttagggtcgggggtacatgtgcaggtttgttacatgggtatattgcataatactggagtttgggcttctatcgaacccatcgcccaaatagtgaacatagtacccaatagatagtttttcaatccttgcccccctcccttcctccccacttttggagtcccaagtgtctattgtttccatttttatgtccatctgcacccactgtttagctccctctaataaataagaatatgtagtacttggttttctgtttccatgttaatttgcttaggatcatggcctccagctgcatccatgttgctgcaaaggacatgatttcattcttttttatggctgtgtagtatttcacgatctatatgcacctcctttctttatccaatccactgttgataagcacttgggttgattccatgactttgctattgtgaatagtgcttctgctgccaaattttgaaccctttaaagatctaggactctgcccatctcacctttgtagatacagcatctggcttagattgaggctcatggtagttctagaaaagaatgctgaatgaatgaatgaatgaatgaatgaatgaggaatgaatgaattaaggtaattgaatccaaccttcattttagaggtataaagaaaaactgaagaaaatatggctttgacctcaggtatctcttacacatagaaatgtcatgagcaagtgtgggatacatgtcagtctgtgtgtcccacacattcctgaaagctgctacttttagccaactggaccttagttgactcttaaaggtgagatgggattcaaatatattgggggaggaggtgccatctccaggtaaaggcctggattatgtcatgattgaatacgtaaaatattttggatctgaaaagatctttgtatgctagttgaattcatacagctacttcatgggaaaattaagatttagtccacatgtgtacagcatgtttcatgataaagcactggacaaataaaaccccaactggccccgtgatactcattccagccatatcatctttctctctcccttacccaccatcttaaactttcaaaatatatctaaaaggaaggcattgttaatcaaaagataaaaaactaatcctctagtaggaggaatgtttatgatttccttttatctgtcataacaacagaaaatagcattttaaacattttaaagcatgatggcaaattatgttttgccaatgtggtatatgaaatggaaatttactctggctcgttcatcctctgtgaataagatgatcctacaacaaaatagcatgcaggctcctctctcgggaacagtgggggtaaaatataaacagtgttttcatatactgtcagacgtttagagggctgccttccatgattttaatattgtctgactgtaccttctccacttcatttagcacatgagtaggttttgatcccatcttcgacactgcatttccccatcatgagaaggccctactaaatcttagaaagtcattttgcttcaacgaagagacagtctcacccctcctgttactgtcatatgcttctttccagttttttagaacatggtctctagaggtgttcaaaaagcaagcaaatgaagcaaatgatcagattttggcagaagttaaactacatgataaatgatagaatttggctcaaattctactggtatacacacagacacacatgtccctctgtgtgtgtatgtctaatatacaaatataaaacagacttcatctctatatgttcagtagaatgatagatactaaagtttttattggacagattgaaagagtaaaccctaaaagacaaataaatattgaagaatctaagatgggaccaggtgttttgtattcagagaaagtttcccattagtcttgagagttgaagagaaagatagctgttaggagacatggcaagttgcagcagcaatcagaagtaaaccctggagtttcttctgaactttgggaatttatatgaacagctgttaagaagctgtgtgtgtgtgtgtgtgtgtgtgtgtgtgtgtgtgtgtgtgtgtgtgtgtatttagacatatatatatgtgtatgtatatatatgtgtgtgtatatatatattcagacgtagtcttactctgtcacccaggctggagtgcagtggtgtgatcttggctcactgcaacctccgcctcccgggttgaagtgattctcctgcctcagcctcctgagtagctcggattacaggtgcacaacaccacgcccagctaatttttgtatttttagtagagacggggtttcaccatgttggtcaggccagtctcgacctcctgacctcatgatccgcctgcctcggcctcccaaagtgctgggattacaggcgtaagccaccgtgcctggccaagaagcattatatattctgagtgcattggtgtaggggtgtgtaagagatgatggcagaagatgattaaaaattgagtcttgtgggagatcaaatgaagaagatggaatctggggataggatctttgtctataaaattattgaaaaggctggtgtgatggctcatgcctgtaatcccggcactttgggaggccaaggcaggaggatcgcttgagcccaggaatttgagaccagcctgggcaacatagtgactttgtctctactgaaaaataaaattagccaggcagggtggtacacacctgtggtcccagccacttgggaggctgaggtgggaggatcgcttgagtccaagagtccaaggctactatagtgagcagtgattgtgccactgcactccagcctgaatcagagcaagaccctgtctcaaaaacaaacaaaaaaaaaccaacaacaacaaaaagaaaattattgaagtagtccccatgatggtaacaaggctctagactggcatcaaagaggaaggagataaatctgaaagcacagccttggtgatgggttggatatgagaaggtgcaataagaggtgaatttcaagtcatgagcctaggtgacaggataggcaagagaattttaggaagaggaggtgatgatgttcactcaactattccatagactactcattcttgtgatgtgttcatgggtgtcacaagaagtaggaattctgtagtcaggtaagtttggaatatactgagataaagttaaggataaagttaaacagtaactgaaggacttttcatagcctttaatatgctgtgatgaattgattagaccgagtattcagtctttgccaaatttatcagattatggggttaagtgttttggagattgtgtcagggagggagggtacactttggaaaatgatttcagaacaagagaatggggcgtgtgtgtgtgtacgcatacgtgggtgataatcacccatcaaagtgagagtcttttgatcataatagatatggaacttgagagaatgtgagagagcaggctaatatgaggagtatttggaagtcaggcagagagatgttcactggaaacatagctgagattagattcttctctatagcaaccaataattaataggaggataggtgatgtgtgttgggggttgaggtggggtggacaagaggaagcaaggcaagggcaaccgaggccccggaagacatcccagacaaatgtgctgtcaccagtaaccaggttggaaagagctggtacatggcagtgattgaaacagtagggctctaatctaagaggcgtagaggctctctggtttgtcaaggaggacgtctcctctctttctgcctgttgtggtaggtgctaatgctagggcaaagggtgagtgaatggtatcccactactccctgctccactcaacagacacttcaccgacctctcattttgtaaggataagagaataatgagcatttaggtcctactctcgaggtgggcactatttctgaaggaaaagggcaagaaaggtagttaaactgctaactgtgacatatttgatggattgattgattgactgactgactgactgactgactgtagagatgaggtcttgctatgttgcccacgctggtcttgaacttcctggctcaagtgatcctctcacctcagtttcccaaagtgttgggattacaggtgtgagccaatgcccccagcaagtgtgatatacttgacaactgcttctacagcagctgtgaatctgacaaggtctttaactgtgggcaaagaggtttaatatatttgaattctctaactttttgaggcaaccaaggaaataaacatcatatgaatagctctaagtcttaagcccaatttcgtaatcagaaaattactttttaaattttatttttccttataaccaagtttaaaaatagactgggaagcacacccctttggagaagttggaattggcctaacagtatgtgaggtgttacaaaggtaaaccctggtcctggaatggaattacaagtgtagttttttttcttttaccggaccatacgctttatttttagaattttgcgttgtattttactctggtgtatcttctattgatatcaaatagtttaagctgggcccaccaaatgtagatgagatgacagtttctaatgtaaatttctaagggagcagaaaagcttccggggaagcacacaaggcaccccattgtaaggacactcctttgtgctagttcttttctggctttgacttgagctggctcacagggcttctgctctgtgcctaccactcctcaccgagagccaagaagacttttcataatgccatctgtcataggtgttcatgaaggggacatgtaaaaataaatataaaaagtttacagtgagttttaatagcagtttagggatctttctgaattatggtaaacaaaaactgaaaagttacagatatggtcatatatagataactgttttgaccctcctcctgtcactgtgtcctgtagctctctgtatcccatatatgagcaggattcaggataactgtgtggaatggttgggcacccctcagcacaccattctggagaaccaaccccacaactgcagtttcagtgtttgctttgatgttcaccatcctcctgccttttttccccactttcctgcctcacactgaatgggcacttgataaatctgtactgaacagaaagggaaggaatcctctcagataccagtgttgtaaaaggaatgccatcaaagagtcatctttatcttgtgtcttagcagctgtttgaaaagtgatctcttgtgtttgactttgtgtgagtgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactgtgagtcaattaaacctctttcctttattaattacccagtctcaggcataactttactagcagcgtgagaaaggactaataaggtgagtgtttgagtactatctatggatagcttctcagaccaccatcttcttcttataatagctgccagaaagccaggcctctggacaggggagctttatcagctgctagaatgcaaggagctctctctctctctgctcccactacccattgaacctggctgcctttgtgatatgagagttgtatgtggtattcttggagaggagattttcagagattttcttctccttagcattgtcctataattggaagcttggagtttgcatgtgaattggaataaagtaggagaaggaattttatactcttgatttgagcaggatcttggtctcacgttctgcagtcacaaagaaacaaatacattagtcatttgggaactagattcccctggactccaatccagcgattgcctttcccgtaagcattagtttcttcattttggcagagaaaacaaattagttgctccactaactgaaatcatatggtggttatctgtcttgatgctgtaccactggatcttgtagcgctaggagtacatatgatactcccactgtacacgaaaatcctgaaacgtttatttagtgcttttggcaagacagcaaattggagaggtagttacattattaaatgttcaaaggaatgaactttctgaattattgatttttaaaagtcaggttttaaatggagataggtatgtggcaagaaagacaaaagttgacagcagcctggtaattaccatgtgtagaagaagatccacagtgatacagatacagctctatccatccaaccacatgcacatcctttcccagaccaagcagatctgactaatgtgggtgtgtgtactgggaagtcttcagctgcctcacagaaggaagaggaaataatgggccaagttagggagaagaacctgagagtctgttctataaagtcatatggcaaaatgggtctgtttccagatcccccgggaggtgaatgggctgtgtcctgagcatgtcaacacagccccttagtgcatggctggtgtttgtcgtggataagccaccttccttaaggcactcaggggagcaagaacactgtggaggaagccaaaggggagatcctgtatcctcttccccagccactgcaagcctaacatccctctttgttgccttctagttggaggagagatgtatggatgcgattcctgattgttctgtccacttagccctgcagtgtagctgaccttcagttatccatgagatatctgtgtactggagctagacattgcgttcatgaggcatgccctttgaaatttgggattctattcattttaagcccaattagccaaagatgttttcagaggtagagggaagctggaaggctgacgggaaagcaataattcaccaccgtttttctttgctcctgtatgtagggaagggcgggggctagaggttctcaactagggatgtttggaaaggtgtgtggtgttcagggtacatgcaatgactgggggacactatagactttgagtgggtagtggcaagggttgctaaatgtcctttaatgtgtgagccagtcttctacctgaagaaacacctcacctaaaatgccagtaaagggtaacactgagaaggagaaacaggatttgggcctctatgaaggctcatacagtcatgagagtctgcctgcttagccttctgggcagtctgtccccagagaggctagatacagccttccagttttggttcaaagccacctttctttcttcctttctttccttccttccctccctccttccctccctccttccctccttccttccttccctccttccttccttcatctttctaactttcttccttccctcctccctcttgccctccttccctccttccttccttccttccctccttctcttttcttcttcccttcctttcttcttctccttccttccctccttctccttctttccttccctctttctctttctttctgtcctcctccttccttccacctacccatcccttcagtggccaactatcctcccccatgtttccctcagcaatgttgtcacattgtctgatctactgtactcaagttcctctctgaactgagtcatttagtagcaatgacaagttcttaggccagtgagaatagagaaggcagatgtgtttggtgggaaaggagagagagaagagagggagaagagttaaaaagatgtttcataatttatctaggtatgagaataggcccctgaagttttaatccaagaaaaggcatttgattaatactaatggactccctcccacatctaggtcagtggttctcaaatgtgagcatgcatcagaatcccacggagggtgtgttcctagagactgctgggaaccatccccagagtttctgattgagaaagcctggggtggggcctgggaatttgctttactaacaagttctcaggtgctgctggtgcagggaccacacttctctaggtctgggtcctagagacaagagaaacactaggccaattcccatctccggagcactggcaggaacaggctgagatggggagaaactttgccatattctagacttttaactatggcccatgaaggagaagggaagatttaaggccagcacttcccagaagatgaggataataccagcttcaccatcacccctgtcgctgggatccatgcagaggccagtgtgctgtgttttctgaaataggaaggaaacaaaccacagtgagccttacttttttgtgtccttctgtaccaaagtaagtgcattgaattggtggccttgcttgatgtctggtagcttggaagttttggtaagccaggatatcaaagatgatgggcaatactttcttctgttactaaagaaggggaagttgtaaaaatgtgcaacctgttgaaggtctctctaaacctgttggtttaatgcccaaaccgttacatgtgtccttttttttttttttcagggaagcaaacaaagtcaggagtagggacagtgtttactattgcctttcctgaattctttgttcagtgataccagaagcactggttgtttttgttttcctcttcctaatgtgttaacaatggtgatgctttattccagccccacaaagggaaaaacaaatatgttggcagggatgctgctagaagtgtgaacaggaatgtgaatgaaatgaacactttgagagctgctatttttactatcggtacctgatttttcaaaataattctaagaacagtttttcatcaaatttgacctgatgccagaataacatcaagcttttttcatccctgatgttcccctggaatcatcaaatgttattagtttgagtacttagcggcagtttagaggtggcatattattttggtttccattttttatccaatacagaaggccctgcggcactaaataaaaatgtcaccgtgtaagacgtaaaggctttctgtcacaaatgtttttaaaaattcatgaagggctgaggatttgatttatcttatcctctttctgtgatttattcatatttaatgttgggttcaacgtttgaagcatgaataactttttcaaattaaaaactgtggtgaatcagttttttttgaagaaaaattctaccatgccagtttttgaattatgcagttcattcctcttcatgtgttcaagggccagagatgtttgattttcccagtggctggaattctcactggcaaaacccttcattgttgcaggagaggttgatttccccagctacgtggtcgtgacagctgttgccctggtatcaatagacattttccctcaggcatcaatcatgatcacacacgtgtggtagcaaaggggaagagtgggaacagacctcgccttgggaaccaatggatctgtatatttctttctatttttgagctgctgagttgcctgtgtttttaggaacatctttaggcagagataagatccagtcttctctatggacagttcataaataatgttaatagaattagccgcaaatgaaggaaaggaaatgaactcaaaacaaactcataatctttctttttttgaactagtcagtggaagcatagggtctgaggcgctggattttttctaagcccttggaggcttaaaagactataaggaaaagagctgcttggtggactcatttttgcctttgtggcaggcaggtagatctgtttagaggacatgagagtatctcccctttctctgggaggcaggtggaattctagatggctagacagagatgcaatagggtacactgtcctggacatcctgacttctgcctgcccatccacctgcctgcccgtcctgccctcctgggcctccattcctgtatcccttccttttgatttcttccctcctacttccatttttccagcctgcagtgacttttgagcatctccgttgggccagctattgtacctccatagactgagtcagcttctcataaactgaggggaactatgcctgttttctttgctaaaaatagtcaaccttttataagagtataaaggaagaaagagaataaacgctactaagtgcctacaaggataaagccctttttacctatttttctcccttgtttgtcattgaggatgaaacctattaaaggggggcagccagtatacagagcagggcataaaccaaagaatgtggctttttaaaccaatttcgagcattttgtcattatgatctggatcttattcctttgcttaatggagacaatcatcttgataagtaaaatcatctgtttttcccctcagactattgggaagaagttacctgcaactacagcaactccagactcatcaaaaacagaaatggacagcaggacaaagagtgagtttccttagttatctgtttcacatttaaaagcatttaaggatttcccaataacagaaatgttttttagaaatccctatataaccttgatagcttttgcaaacgcatcagaaaaatgtacacaattgtatttcattcaattccccaccattagggtgggcacaggttagattcagaactcctgtttttgtttttttctttccccttattacagaacgtggttctctcctgctatatgtatctcactcgtatgaagagctagggtttatccatatataacaagcactttgcacagttaaggtggctgaaagattttagagagtggcaaattaagcgctttagggattcacgagccctcaggtcggagaggcctaaccacttgaacttgaccaattttacttacccttgacttcccactggtatcttcaacacatctctgcttgaatatctccagataccactgcatgtctgcaggcaggaggctcaagtctttttggaaggattaggctaatgaatgggaggggttaactgtgttttagaacagtgctagccaatagaaatatcatgtgtgagccacatatgtaattctaaattttctagtagccatgtttaaaaaaaaaggaaaaacaattggacttaattttaatgtatttttatttaactcaatatatccaaatattatcgccacatgttatctacgtaaaattattaaatgagatactttcattgctctcttcatgtgaagtcttcacaatcccatatgtatttcataggcatagtatacctcaatttggagtagctacatttcaagcactcaatagtcatgtgtgcctagtggcaaccatattggaaagtgtagttttattttttaaaatattttctttttaaaacaatgttgtgggtacatagtaagtgtatatatttatggggtacatgagatgttttgatacaggcatgcaatgtgaaataagcacatcatggagaatggggtatctatcccctcaagcatttatccattgagttacaaacaatccagttacactctttattttaaaatgtacaattaagttattattgaccatagtcactctcttgtgctatcaaatactaggtctcattcattcttactattttttgtacccattaaccatccctcctaccccccagcccccaactacccttcccagcctctggtaactgtctgcctactccctgtggacagtatagttttagagtaattctggggtccaagaggggcttcctgggcttgaaaatgaacacagttccaaatgctcagcttgcctaagcatgtgggagaatcctggctccagcccaagccttgttcagtcctaaaagcgtctattaactacatccacatacctggccctctaggaacagcatggtgggggatgggttactcaaaagagtgggtttataggaagcccatattctaggaccagctctgttattagctagccatgtgaacttgggcaagtcattttattcctttggccttcctcttcatcatctgcattgtctgtgaagtcagagggttatactagagataaaccccagggtttatcccagcatcttcatcctctcattcagttctaaaagctttacaattcagaggggaaggtttctgcattcaaaaattaaacagctgatggaagagccaaaaggaagatgtgaacaattcagtaggaatatgagaaaggtgtctttgggtatagatgttaatatgcctgtaaatggtagcaggtcaggaaagggaattattactgtcatcaaaggcttgagggatgtttattgacagacatttttcatagacaccaggataagaatttctacagttgggctgggcacagtggttcacagctgtcgtcctagcactttaggaggctgagtgaggcaagtggatcacttgagcccaggagtttgagaccagcttcttggaaggctgacatgggaggattaccccaggaggttgaagcagcagtgattgagccaaggtcataccattgcactccagcagggtggcagagtgagaccctgtctcaaaaaaaaaaaaaaataaaaaaaaaaaaaataaaaaattcttcagtttcagcccacacacactgtctccagttgtcaagagcaaattctggggtaattgttcttccatgatttccatttagtgccaccccagacccctaagaagccccctaaaaagcccctttcatttggaccatttccctgcttcgggattttgatacgacacctatgtttaggtaacaggccacagagtaactgaacaactacatattagaaatgaccctgagcttgggatctgagcaacctccttccctcttccttctggccagaagacaaactataacaaaaattgcccagcagtgcagaagagggcagctccttcctgcgtagatgtctgtctccttagcatgctaaaatactagctcacatcagggttaagagttgtgatgattttaaaaatgttgatatgagttggtattttctgagtgaaagtgaaactcagctgatcaggatttagttaaacaacattatcatccccaccctctcaaaaaaaaaagcttttatgatattgaaattcatcagaaactcatgctggggaacagattgacataattttcataacaagaggaaaactgtctaaatattcataatgaagtgccctgaggttcctccagctcaccacatctggagtttccctctttcttattataattgatacagatttgtggcctctgtgggatagaaaaatagcccaaagggctattgaatatttttctgaaaaatagttcagtcttacagattcagaagaccagctgaacaggtgggttggggggaaaaatccttgacagaatttgtacaagggcagatcaggcttctgcataaattatgactgcaggacaaaggctgttttccctgctgaacctcatctcacttcctaactggacactcataccgcctttgcaatccctttgttcattgacttgcttcttaggagttctcatctgtgatggcaacaaatggaaccttgttgctatcattagatcattggtccctctaggttgaggctgtatcttctacttgatatccccaccatgcagcctagaaaagtgccatggattcagtgggcacataaaaagtggtggttgagcaaatggagaagtataaatgatttatgatttatcaggctgtagattgcacagttttttaaaagccgttagcaccatgcacggtggctcatgcctgtaatcctagcacttcgtgggggccgaggcgggaggatctcttgagcccaggagcttgaggccagcctggacaacacagtgagaccctgtctctacaaaaaatagaaaaaattagttgtgcatggtggcacatgcctgtggtcccagctccttgggaggctgaggcaggaggatcacttgagcccaggaggtccaaggctgtggtgagccacgaccgtgccactgcactccagtctgggtgacagagtgagaccttatctcaaaaatatatataaaaattaaaaagctattagccattggtcccctttgccaagtgtacatatacctgtatatgtaagcccctcacaatgagaccttaaacacaatggtaagaaacatctttcgaaagtatgttccaaacacctactttaagagccctctgcatggaaaacagttccattcactgtaggaaaacagcacataatgtatctcttaaaaagtatgcttagatttagctctaaaacatttatgtataaagccctcatgcacgatgagatgcaatgctagaaacatctcccaaaaacatgtttgaaacacttgcttacgaaattttatgcttggaaaacagttccattcgctatatgaaaacagcacataatgcatctctacagaagcaagtagatttagcttttaaagttgtatatggaaaccacatataatgaaacttgaaatacaatggtaaggaacatccttcaaaagtatgttcagaacaccagcttacagagctctctgctaggggaaaaaacaaaacaaaacaaaaaatcaaaacaaaatacatttgttcctgtaagacacttgagcatgttctggagtctgagtggttagcagtggttgctggtgttccttggcttgccggtgttccttggggcttgccagaccctctcttcttaccagccactgctctcccaatcggcctaagactgttaccagtggagggtgtccaggttcttggcgtcttgaacaaataattggacaaaacgcacaaacaaagcaaggaaagagtaaagcaacaaaagcagagattattgaaaatgaaagtacactccacagggtcagagcggacagcagcataggggctcaacagccaaattacagaattttctggggtttaaataccctctagaggtttcccattggttacttggtacacaccctatgtaaataatatggtggcccacagtcagtctgattggttgtggaaagcaaccaatcagaggctgaagtgaagctacaaagttacacttctatgcaaacatctgattggttgcagaaagcaactaatcagagatactttcaattttccatctgccccgcagaaaaggagcgggatttgcaaagggagtagcctatggtccttttgttacttaggtgtggaaagttgggattttccttttgatttagttctaggaagtcagcgtgaatcggccttaggttctctgcctccagaccctattctgcctcaagaccaccagggacaaggctgtagtctgacgaattcaggtttattggctcgttgtgaccagggagactgcacaccgggggacgtgtggatgttacaccaagcaaaagcaaaattaaaaaaaaaaaaaaagtcgttgcagattttgagaaggggtggaatttagtgaaatgtaaatgaaattatgttttgataggctcaaggcaaagcagggctgcacggcaaggggtcagcatcaggtcttgactgtgaggtggactcaggtcctgtttctttggcagctaccaagtgaagatagatgtgtagtgctgtgtccagaaacccgttacatgaggcgctgcacttgggctggaaatgaagactgcttctctgggtcaagtggcttagcgccttcaggccagagtggactgtttcattcttcctgatataatttttttaaaaaccaagtttctggtagtttgtctctaaaatcacatactttgtcagggagtgagaaagtaggagcactccaagaagagggttgttaaggacactttgcaactactgcatatgcttgggagagaaacactgtttcctgatcactttgcaggtggccttatctgtgtctgttgccccagcctcaagaatggctgggcagattgctacttactcagtgcagctcatttttgctttctcaccacatgtttaaataggaaaaaaaaaaaaaaaaaaaagagtcaactctcttgtgttgggttttcctcagcttcataatatatacccaggaactctgatcctattttttcagactcagtggttttgctcacatatcctcccccaaactcactcattcttgggcctggggatttgggcacatccaatttgctgcagcatgtctcatattcacccctttagtgcctcccatgcctgtcatgtactgaagcccctcatgcttgatgtcccaggggtacccacctcttcctaagaagcacctttcatcacttgctccccaatacagacattgctgtctggattcagagtgggagccttcccaggagggtgcccagcctacccgtgtggcttaagatctgcatttcaaatacagtcctcttgagaaaaaggttaactccctttgtgttttcctggtaggttttctttctcccaaagactctccaaggagcttctcatctgagcttctcatctgaaagtaccatcgagaggagcagtgatccagcctctgctgcattgtagagacaagaagggctttgcttgtcagattttcatttcttctttttaaaatatacttctctttttagaggaggttaaatggtgtcataattcatacttgtgaaataatttgaaagtcaaattcccaacagcatccgagaccgaaggtggttgtttggagttatggtcagcttcttcataaaggaagacactgggttggcgttgacagacatactgacggacacatcgtgtttcatttctccgtctcaatttaaatgtagaccatggcttcttcacctcagcagtattgacatttgggctggatcattgtctgttggtgggcgttgtcctctgtgtgcattgtagaatgtttggcagcatccctggcctctgcccactagatgccagtagcactcaacccccattccctgccaagttctaataagtagaattgtctccaggtattgccagtatttcctgggaagccctagtttcaaactgctggtatagactgtagtaagccccacgagggcattgtggcatccctgctgcctggcatgcagtggacgctcagttattatttactgaatagatgacaagcctagtatgtatttcactactcctcactagccccagatcctcagaatctgacccagaactggagttcctgtctaaatctagcatatggcacacccacccccagtgctaccaccatacttgtccaccctccaggtccccacaactgttttgctccttcctggaattaaacatttgctaatacccattactagaccagtggttctcacagcgtggtcccagaactagcagcagcaggagcatcacctaggaacttgttagaaatgcaaataccagccctacagaatcagaacccctgggggtggggcccagttgatctatttttacaagctctccacctgatgccaatgcccactcaagcctgagaaccactgacctagactaaggccttttttttttttttttttttgagacggagtctgctctttcgcccaggctggactgcagtggcgcgatcttggctcactgcaagctccgcctcctgggttcacaccattctcctgcctcagcctccctagtagctgggactacagacgcccgccaccgtgcccggctaattttttgtatttttagtggagacggggtttcaccgtgttagccaggatggtctcgatctcctgacctcatgatccgcctgcctcggcctcccaaagtgctgggattacaggtgtgagccaccgcacccggccttttgtttttttttgtttgtttgtttgtttttttttgttttgttttgttttggagatggaattttgctgtgtcgcctaggctggagtgcagtggtgcaatctcggctcattgcaacctctgcctccctggtttaagcaattctcctgccttagcctccagagtagctgggactataggcactcaccaccaagcctggctaatttttgtatttttagtagagatggggtttcactatgttgaccaagctggtctcgagctcctgacctcgtgatctgcctgcctcggcctcccaaagtgctgggattacagacgtgagccaccgcgcccggccagactaaggtttttaaagcttctctgatgatgagaatcaccagagtatgtgtttagtaaatggattcccggtcccacctcagatctgaagattcacatctgcagggaagaggtctgggaagataatagaatgaacaggtgccccacaaaattcttatcagggatgattgattgggaaacataccccaatcctactcctctggtcagtgtcctagaacattgtacaaagcccactgtcattttcttcctctctgacaagatcctgagtctcttgtttgggaagtgattgtcccgtttcagatactctgacactttaagccgaatgcatggctctcatcctatcttcactgttgtctggtcaacactgtatgtttgcaaacccttttctgctacttgagctcctcgagcagatagtgtcttatttaccttaatttctctttcctagaacatgatagaagtccacacccttatgtgccattctaaaatacaaaaagctctgaaaactaaaatgttttattactcattgggtgataaaacttgttctggactgacatatgcctactcatagtctttatttttcccacttggagtgaccagtcatccatttactgcagaattttaatggttgggtgcagccccagcccccagctgaggatgttacgtattatatggtatatgcagtatatttcctttctaaaatctgaataatcctgtccccagggcttctgagtgagggattaccaaccagtagtgtctgagataatatttgtcagttgaacgagagaatttctgattatgatgtgcgtgaaactagattatccctgagcttgatacttttgttgtactgtcccaagggaaaggaaaactccagttttaggtgtgacctggtactttccaaatgctgcttaaagctctgaaagtcttcctagcagaatctgcctatgacacatggggttttgatctttataccctaaaactgaactcagagagttgtcctggatttaatgttatttccttctgtgtatatgttcagcttgctgatatatttattctgttggttctgcttttatttttttttaagctgagagggtttttgcttgtttgtttgaagttggtttgtttttattgaatagattataaaactagctgcaggcagtcatgtgatgtgggcatgtgagttcaattcctttaacagtctgtttttaatattatgtaaatttctaaaagtttagagattgaaataatgttttttggggagggtgtaaatcatgactggacattttggtgattttaatagagcaagcttcttaaaatttgaaagccaataattagtactggggctcttgatgtgggaactaggtaactaacagctttggggtcctcaaaccttctgatattgtatacattttctctgcacatttgagtgtgtgtgtgtatggtttgttgtgttgtgtttttttttttctggaaagagtcattgctttttatcagattcttaaaggactctaagacaaaaaaaggcttatgaactgatttaggatttcagtcttatgctaattcattagtcatttttaacctttctaaagaaaaaagacaaaatcatctcaaattgctggataaattatgctttattttttctctctctctctctctctatgtgtgtgtgtctattcattcctatttgatctctaattaaatccatccaattgatgaatagatggaaaatgcctgcctctcaaaattaatttaattcccttcttctccaactctgtccgatactcatttaaaatttataatcttcccacatccaaaggatgtggaattatacccttcttttaagacatatcaaatgcctcctcttttgagaactttctcctgaatgtaatcttgcctttctctgaaacacaacaatattccatcatagtgagtttatgtgtatgcatggctttgtcttttctttctgccattctcctccccttgcttttctccaagaattagactgtcacttccatgcagggacaggagggggtggttgggcttacttgtatattacagtcccccaaattggcaatgtctttttcatggtggtggtccaataaatatttaagtggaagtcaggaacatctttgttccatatactttaacattaaaaccacaaactcagagttaataatttttttgcagataacaattttgagtgtcttaaagccactgatacatccaatgcaacgtagtattttttttctttcttctaaaaaaaaaaaaacgggatacacgtgcagaatgtgcaggtttgttacacaggtatatgtgtgccatggtggtttgctgcacctgttgacccatcctctaagttccctcccctcatcccccaccccccaacaggccctggtatgtgttgttcccctctctgtgtccatgtattctcaatgttcaactcccacttatgagtgagaacatgcggtgcttggttttctgtccctgtgtcagtctgctgaggatgatggcttccagcttcatccatgtccctgcaaaggacatgatctcattcctttttatggctgcatagtattccatggtgtatatgtaccacattttctttatccagaaatatttttattttctaatactactgaattcaggctcaaatgcctcatcaataaaaatacattcctgttttaaaatatgtcataataaattaaagtgtgtgaagctaatggttgccgggtttggtcaggagttctgggtgatagtgcctgtgactagagtcatgaaaagtcacagctcaaagtcagagctcccaggaactcaggtctagcccagtgtgccccttggagccctcagagcttcactgacatgtctttggggacctgggtgggagatgggacagccctactccccaaccagaacagctctttttcagttcctttatatttgagctctggaataccttgaaatttgctaagtgtcctgctgaagttaaccagactctcctctctcccctccttagctggtccctgattttacacctgaggacactgaggtcatccagagttgtagtgtgattgtctcaggtcatgtgcttgcgaaagcccagctgggaacccaacctagtcccaagtatcctgccttctggcccaccgtcctctcctcctcctccttgtggcccctccaagtgttcctccactttataggggtcacttggagatcatcaagaaacattgagtgggagctctgtgtccggttttggggggtgcaaagagggctgagatatgctgcagcaagccctggcaccaggatctcctctttttctctaacagtggtgctttccagataattctgtgtctaatgccttacacataaaacagcatagctgcacagtcgaagtgttctaaagctggattatggtgatggttacacaactgtataaatttattaaaactcatcaaattatcactgattttcttggcattcctcttgcagttgaaatatgatttcaagagcaccaaacactgtactgacgtccaacaaagataaaactgttaaaaggagaatggcaggggcaactgtcttcctcaagtctgcctgtctgtctctctgtgtctgtctgtctctctctctctgtctctccatgtctctctctctctgtgtctctctgtgtctctcggtctctccgtctctctctctttctttccctctgtcacacacacacacacacacacacacacacacacacacacacacacacacacacacacacacacaccagggaacaaaatctaacagcctctcccacccccagcagatttcctctcacatctcattggctgcaaatagagcacctgcccatccctaaaccagtcaccaacaaaagagagtgagattaacattatttgcctggacatattttgctttatccccagggctgtgagagggttccatgttcctgaatgtaatgcctgaacaaattaggattctgtgaactaggaagagggtggggaatgtctgctgggatgttaaccaacagtctctattacacttaattaactttttttgactgaagggaacagaaacatgacctgttctttctttgttggctgtgggtttctgtattctttgtaaaaattgtttcatgatttccatccaaataattattcttaaagccaggactctgtagtgcagttcttcagtgatactgtgtttgtgttgttgtaagttttgagattggcagtcatatttcactagcacagtcaataggaaaattggtgaggagctgtcattatccaatttaaacatgttttaactttttctgtctctgtagaacatttgaccaattcagatttggggaggtttgctattactaagtaaagagagatagaacgttggtaactatatgggtttaggaatatggtattgatggaatttagaactattgcccctcagcacaggttaaggggcaaaagccatcagaggcccagaatacccaagatggaagatttccaacactaggacagggaatgtaactaatattttcaagctattgtaacagaatatgaaaacatctgcacaaaagcaaagtgaataccgcctctcctcccttcactccttccccttccccttcctccctctcttctctgtcctatcccaaccctagaccatagtgtatctgtattatggatttcttaattgcttttattttatatgtcacaatctctggttgttgggatgttaaccaaaataaataaacacatttcagtaatataaattacactagggacagtataattgtcatcaagaggttacctctaagacatagctctaggttgtgatccgtctgcaggaacgggcctgatgcttgggaaatatctaaggccattcacagccattaggtttgttgactttgatgcagaataatcgatgcctgtcccagtagatactaattctcttgaatttttctgtccaccttctgtcctgaatcatcaaggcctagttttccaagtctccatttccgaaatacaaatgttttcactatcttcgtaacttgtgctttcagataaatagagatgatttaacagcacatggactttcaaaagcatgtaattcaggacatacttaaatcgatttttagtggccttagtatttttccctctttggtgagggctattgcatctctttgctgaggaacagccatctatgcatagggaggttcccacagaaaggccatgggacatatttgaacaagcttacccccacacatatgtgtgtaaagaatgttcagtcaatacttgttggctgtttatggttggcatgtgcttacatagaaatacattgacatttgtctcttaagacgtaccataatggggtaacttttcattgttttatgtatcctgggtagctttgtaacatgtataaataccttgtttctaatttagtaatgtgtgggaaaaggcagtgaggcaaaacttaaggtttttttgccctctgtagactatatatgtttatgcatgcacctgaagagtatataaaatggtatatgtctgttttcctgagtaaggaaacctttttacctttctgccagagaaaagcaaagcagtcaggggcatctcatgatgtcacatgatttgtaaggggaaaaaaagtggaagccaataaatatacatgagccaaaaatgagcactctcgggtcattttctgagggtcaccctttcttcatgcagcagtaatatgctacctgttaagtgtgcctttccctgaacttaatgtgatagagatcattttctcctgggccagctcattagataaagcattttaaaggttatgttttctgtttttcttataggcaaggattactgcaaagtaatatttccatatgaggcacagaatgatgatgaattgacaatcaaagaaggagatatagtcactctcatcaataaggtaaacaaaggttgtctcctaccttctaaatcgcgaactgctttggggtgttgactggacagtataagcttttgcttcagcgcttgaaagcttggttttctcagtcctgaacttgtgaggaagaatcttgtatctttccttttgatcaagctaagcccagcatccaagtgaatgcattcgttgagacgagaatagatttgtttgccttaggaccagctgcagatttgcatggtccttcagaaaagtctgttccagaaggaataacccaaaaggcagcctgctcggctggagatcctgccctccacagcagccaggctgcagagctctgtgtcctgaggtatccgaggaggagtttttttttaaaacgctggtcatgcctcacaggcagaaaacgcttaaagaatgtttgctgttcagatcaaagacaggtagagtgcctgagagaatttttcctgtctcgtttgggctaagaagattgaatgattttattattattagagccagagccctgtaaataaacagagagctataaaatctgtgtgaagtgatgcaattgaacaagggccttggctgtgtactttgtgtgctttcacacaatggtactcaccaagtaggtggttgaaagatatattatttaagcaatacccagaatatatgactttttctctgaagaacagcatttttgtgatggtcaaatatggtaagaagctgaatggtcttgaagatgtgtatggtggttttattcttgtattcaggggagtgacagggaacttagcacagttcccttagcacaagtgtgacttgggagatcatcgtggctgcctgcgctcgctctcgcagggctgggaagccttggcagggtggaggatgcagggaaggggaagagattgcaggtgcatagagtgggagtaggcccagggtcccgccgactgtggccattactgagagggtggagactgtggtgtcacctggccctacccctcccccagggcttgtccataaggtgatcagtaagatttgcctttgttatcaagaggttacctctaagacatggctttagagattgtgtgttttaagagccaaatccaaacatgtcagggaactaatgacccaagaagttaactagcttgccacaggtcaggagttttagggagaaagctggtcctctcatggactccatataacagtggtatggagtatataatgctttctggaacagcaaatcattccctgttttgcagatcacccaagaactcgtccatctttttacctgtaaagtattctcccctgaagttatttcagtatgtctctgtaggtgttgaacatggcaggaggaaatgaggggaagaatgcttcccttgttgttttctgcaaatgaggcagaagtgattcttttctgtctctttcagattgctttctgacacacagtgcatttcctatttttaatcagacctgtaaccaaacaagcggaataaggaagttgttaaatgggtgtgaagcacaatacgaatgctgtaataattagcacagataatttggttttagaaatactgggaaagggctagagtgcttttttcccccttgatgataaagcaaccagagaattaaataactgctattctttgcagtgggagggagcgggggactcactagcctgtttttgttttgtctttggaagagagggagcctctttttagttgaaaacctggtatgtcaataatatttaatgaggtctgagaaaagacacacatctgtttctattttgacatattatactccagtccttccatttgaatacatatcataatgagaacacattcatcttgatgattttgttcctaacctcccagcctgagatccagtctgataaaaattaatgtgatttttctaatgaccttagtcagaaagggagtatctatcggtcccatccacatggtacagataaatgaacaggtagatgtggcaagctgctttcaagagtgttgtgaaggttacatcccatttctctggtttcatagattaacgtatttgaaagcaatttagaaactgaagcagcgcactgctattaatattatatttgcaaaacatgacgttgtcatctctgctgtacacttggtctgttgacctgactttcacattgatccaactcctcaggcctagagttctcatatcaccattttgacacttggtcctcctagtcccaccctgctcccacccacaagcctttctctatccctgccacttcctgccctgcagagctaagcacaggcttgagttgttctgtatctgtccaggccaggtgagcaaggaccaggcttcctccatccttctttctctatcacccaccatagcacccggtctggaggagagccctggggtagtgaaggatggagggatgtttccccccactccagtgtcccctacccacttcatccctagcacctcagccccttctttttgtcattctctaacactgctgtgctcacttacccttctgcaccaatcaaaatctttagtaactttctttttctttattgtaaaatccagatagatgatcctagcactccttcacccgtcctgacctcagtctgtcttggtggccttggtccatgtggctgttctgcaggtaccccccgtatatccccctcctgcttatgtgtcctcactaacttgactcagaccatgttcctgatgcccgagatgccctctgcctacccacattgctattttttgtttgttttgctttattttgtttttgagacagggtctcactctgtcgcccaggctggagtgcaatcgtgtgatctcggctcactgcaacttccacctcccaggttcgtgcgattctcccacctcagcctcctgagtagctgggattacaggtgtgtgcctgtacagtaaatcatgcctggctaatttttgtatttctagtagagacggggttttaccatgttgctcaggctggtcttgaactcctgacctcaagtgatccacgcgcctcagcctcccaaagtgctgtgattacaggcgtgagccactgcagccggcctagccactgcacccggcttccagtttgctgggtttttttggatagctaatcacacagccagtcttaactcatgctgcttgggcccattttagagcttgctgcttaagaaaatcctttgtgctctatcattttgcttttattatttttttatacaacctgctgggaaatcaaatctcttgctatcctgtgcttgtgcagatttttacttttatttccataaaatgcctgccagccttaacctagcattccagtttgccggaagcggtgtgttcagatgacaagtgccatgtaggctaccagctcccagaaccagggtttgaatcccagctccactgttcctggctgtgtcttttcgggcatgttgcttaccccctctgagtctgagtttcctcagccataaagcaagggccataaagctgacctcacagggctgctgcgaggatttactctggcagggaggagtctgtcagtggcacccataattctaggaattgtcacccaaccctggctgctctttcttgggccctggaagtgggaatggaagggctgttgtgtctgagcccagtttgctgctgaggctggaatgccatgacgttaagtaggttaaaatggtgaaaaatccacctaaaatagttaagtgttcacagtggaggagattttagcaagaatttggaaagaaaacatgccataaatattttgcttgctgaaagtgggaagaatggagtcggagcctgtaaaaccctgctgacattatagaagattgttactcttcctctaagttaggaatcgcccagaagttcattgagatgattgtatactattgctattataaaatgaatggtttcaccatgatctgtttaatatgcattctgatacgcatatttattggatgtaggagttgaggtgaaagacctgaactgctgttctctaaattctgtgttcgccgtagaggttcctgatagaccccgaattcctctgacatttactttggtatcattgaaggtggtttccctttgccctgcttttctgtgctgtagcaggagtcacagagcaggctttgccctcatttttagccccagattgtcagttcatgtggctttctagaaaatgagtcagacacctttagtgggtgtgtataagccctctgcagttcctgaaataatgtgcaaagacccaaactatttctgtatgtccctggaagccaggaggaaatgtggcaacctgaatggtttgttttctagtttatttataaagaattcttgtgaatttaggaacatttccactcgtgcagaacacacctgtgtttagcttttatttccagtcactcaaaaataactcccgtgtctgtgttcctgccacccccatccctgccttcctgatttgtgctcagagtgtgtttgaaaaggttccgaagcttctgggtctcatcccaactggagaagcttcctggagaagggctgagggcagcttggcaggagctatgccagggctcagctgcaagggtgagatggccattggaaggtgtcccacgctgtggccgctgccgcttggggcagaatgagcccagctgtggagagtggccatgttcccactcttggccaacagcctcctggcctcagagcaacagccattcctcacagctcccactaacctaggaggaaaggcttcctctgtgaccctattgtaaacaaggacctttaggtgtttcttatcaaacaggcttccttgggtagttgtgtctttgacccttaagcatacccaacctccctgtcttcattgttttaagcctatttgatgacatcaagatgaacgcttagaaagctaacgttattggtcaaaatcgtggagtcgtagagatggagggaagggaacggaagcaatattagctagcattaatgttcatggaaggaaactgatagacacaccctagagaaagaggggacccaggccgggctcagtggctcccgtctctaatcctagcagtttgagtggctgagacgggaggatcacttgagcctgggagtttgagaccagcctgaacaacatggtgaaaccccatcttcaccaaaaaatacaaaaattagccaggtgtggtgttgtgttcctatagttccagctacttgggaggctgaggcgggagggttgcctgagcccaggaggttgaggctgcagtgagccataattgtgccactgcactcaggcctaggggacagagtgagaccctgtcccccaaaccacaaaaaagaggggacccagaatattagctaaagacggttagtggcatccccaacacagtagtacagtcatctttccttggaccatgaggattatccactgaagattattgacaacaattttaatttgcaccctgtcctcttcccctcacaatgttcgttcactcattcattcattcattcattcattcattcatacatcgaagaatatttatggtgtgccaggagctgtgcaaaatgctggaatacaatggtaagccaaaaattcaaaccaggaattttgcttctttgtagggaccccaagtatttggagctagacatgctgtgagggcacagttagaaccgctccttttcatctctacctcaatatgttttcctccctcctgtcccagacaacagttgaacatttaattaacttaatgatagctagatctttctccaggaccacagcttcccagcacaggattctgaaccactggcagcaagagcccgggaccatcatcaccattcccctttcctcaggagtctccccggagctcagcatttcccctcatcttcacagcaaccccgggaattaggtgggaccatgcgtgttctctgcagattacaaaggaggagcagaggcccagagtgctgaagcagctttcccgagggactcccagcaagtcagtggcagagccaggtcagaggcatctgctgaccctgggccaagtgctcttggaacttgggggctgggcaaggtggtaactgcgggtggagttcgtgtttcctgtggggctgagtcacttccagaggtgactcttgtctactcattgagagtcctcattgttactggatatccagggcaagtgtctgtggagtttcctttgtaaggtaatgacattatcattgttacttagcagaaaaacagtattaccatgccatcaccccatcctttgttgctgatgctcgcgttttgaaatctatgtttccgatctgttagggtcaggacatcactgtggtggtttctggatcatccatgactgtaggagtccactgccacctctaaaagagtgaaatgatggtccatgcagagggaatgatgagttcagctcagggttgacattggttctttttgtgcctgaggcctgcctccccaactgctttcttccagtttcttcccatgcccagagtattttgccttcctcttttcttcctagcctggttgccacttagctttccactcgctgtcggggggcaaaaaaaaatgcaggcgggagtcctgaggcccttcctaagacattctgtgatcaactctgttattttttttgttctaatgtttatttccccttcctgcctccctcccattaattcattaatgaactaaaacatgtattcatgagaaaaatgttttcagacttccttgcttcccaccccacaggaaaataaggttgccttcacaaagagaagcagcctcaggaatctcaagcaagatccttagcttggcaggaagaaagccgatcagctaaatcgattgctggccctgaccctttctctctgaactgctgaagcttttagcagagctcaaatggtaggattaaatgtggttccaagggtgaggagtaaattagcacgtgtcaccctgaagatgatgacatgctgacagacccattagacagacatgttttatgagtgaatgaagaagttaagcataggtctgggatcatctgggtttacagacatttggaaaatgtcagtgttgagcaaatgagtcattgatgtcatagaatgtatttcttgcagcatggcctatcttgttagactgcttatgtccttattctagacaaaagtcacaatatatctcctcctcagagcatttaaaacccaaaggagtataatttgttgctgttttgtcttccttttataagtagccaggacactgggaccagtgagaagaatcattaccatcacacagacatagttttaaattacatgaggatggtaaacatagggcttggggtgggagaaaatatcgttttagttcaccagtagacagttgttgaaaggccaccccaacattttgatggtcgttattatagatttttcctttgtatcatggacagatgagcttgcagctgatgtaaattcccaggtgcatatgcctacacaaattatataaaactgtctaaagagatcctgtgtttgttcaacctaattgtcatatctctgcagaatgttgtgctaaagtggcaggacatcagtaatcccccatcttggaatacttttttttcccctctgcaacacacagaaaaaaaaaatctgtaggtatcttaaggaattagagaaactccccttttttttctgtttctatctccaccctttctatttgtattactctgttaggggtgttctgaggcttaaatgacatgttgtattcaaaagtgctttggaaacataaaggttaaatcacagggctgggtgtagtggctcacacctgtaatcccaacactttggggaggctgaggtagaaggattgcttgagccaaggagtttgagaccagcttgggcaacatagcgagagactctgtctttacacacacaatattttctttaaaggttaaatcatagttattgctatgataagttattagaagaagatgaaaagacaaatgcctggtaactgaatgttctttcctggtatattgaactgtcctgaaattaaggtcagtacttcccctgaagttccttttcattatttattttagcttttcttaggatgaaagtaatgtattacagttgtgtaacctgtcttgttcagtatctcagagtgctttgcattcatatttgcattttattaaaatacacggtttctgagatgaaagtggcatgggatatacttttttgtttgtttgttttttgagatggagtctcgctctgtcacccaggctggagtgcaatggcgtgatcttggctcactgcaacctccgcctgccgggttcaagtgattctcccgcctcagcctccgagtagctgggattacaggcaactgccatcatgcctggctaatttttgtatttttgtagagacggggtttcaccatgttggccaggctggtcttgaactcctgacctcgggtgatccgcccgcctgggcctcccaaagtgctgggattacaggcatcagccaccacgcctggcggggatacacttttaagtcatactttaaaattgtataaataacacttactcttggaaaaaaaatgagaaaaacagacaaataaatacaaagaaaaatcaaaattaccggtgaccttaccaccttcacatacctcttaatattttcgcaattattctttcagactttttccatatgtgcacataattacagtttaaaataaaaataggatcatattacatacactattttataataaccctctttgtccaaaatacatcatgattatccttggcagcatgggtaaatgattccttagcatcctgaatcctaatgtatggagagagtaccaaaatcctctttttttttttttttttttttttttgagtcagagtgtcactcttttgcccaggcttgagtgcagtggcatgatctcggctcactgccacctctgcctcctgggttcaagcgattctcgtgcctcagcctactgatgagctgggactacaggcctgtgccaccacacccagctaatttttgtatttttagtagagatggggtttcgccatgttggccaggctggtcttgaactcctgacctcaagtgatccgcctgccttggcctcccaaagtgctgggattacaggcgtgagccactcggcctggccctcgacaatcctcttttatgcttagcttgtttccagtttttctttgtgttagaccatgttgcacatagtcgtcaccctgttcaacagtctttgtgtgcatttctgccacttccttctagctgtgataccttggcaggttactcatctctgtgtgcatcagttttcacatctgtgaaatgagagtaataatagtacctacatcctggtgttgtgaagattaaatgagatgaagtaggtaaagcatttagaaagcctgggtcctaatagctgctacataaatgttagcagttactatttcctgatgataaattgctcagtgtaatactgtattgatgcattttgagggcatattgaggatacatcctgaaagattgtgccaatttagtctcctcacaggagtgcatgcaaatatatttccctattcttgtcatccctggatattatcattctttttaatctctgctaatgtgatttgggctctgctaattctgcattttaaaaaatgattaccgagcttgaacattttatgcatcatttccaattgatttttataaaaataccttatattcatgacattaacctgtcatcttcatattacaaatattttttcttagtttatgactcatggagatctttaagaaaaaaagtcattaaaataagtgccttttaggcttaaaatttcctcattttatagttaactgtatagtgcagtaaaatgtgtccttttaaaaatagttttgattaaggtttttatattttatttctagctggaaatggtagccaactattaaatgcattctttttctgccttcctcagggctttcagtgtttttatttaaagcttctgtctttacagtattttttttatagtggcattgagagagtccctgaggttctgcatggatgcgtataaggatcctcatatcctagaacagggtttggcaaacttctgcagagggccagggagtaaatatttcaggctttgtgggtcatgcagtctgtgtcacaattactcaactctgccattttagagcaaaagcagccatagaggtaaatgaatgggtgtagcagagttccaatgaaactttatttatggatacttagatttgaatgtcatataattttcacatttcttgaaatattcttcttcttttgatttttaaaaaccattcaaaaatgtaaaaactattcttagtttgtggaccatagagaaataggtggcaggctagacctggcccatgggctgtagtttgctggcccttgaaatagaatatctggaaatagactcataaaaaaatccagccgattaattttcaacaaagatacaaagacagtttaagagaggataatcttttcaagaaatggtgttggcgaccgggcatggtggctcacgcctgtaatcccagcactttgggaagccaagacgggcggatcacgaggtcaggagatcgagaccatcctggctaacatggtgaaaccccgtctccactaaaaatacaaaaaaaaaaaaaaaaaaaaattagccaggtgtggtggcgggcacctgtagtcccagctactaggaaggctgaggcaggagaatggcgtgaacccagaaggcggagcttgcagtgagccaagatcgcgccactgcactccagcctgggcaacagagcaagattccgtctcaaaaaaaaaaaaaaaaaaagaaagaaaagaaatggtattggcacaattggacacccataggcagaaaaaaaaaaaaaaaaccaacctgaacctattatacaaatttaactcaaaatggaccatagatctacatgtaaaacataaaacatcaaaagttatgtatgaaacactggagaaaagagttgttagacatgataccaaaaacacaatccataaaagaaaaaacttgccaaattgaacttcagcaaaattaaaaacttttgctctgcaaagacactcttgagagaatgttattggctagtctatttttcctacaaggccatctaagccccagtgttcagtaagtaattgcctgctacgtaattgcgtggatttgaaggaccttggtttcattctgagtcttcctgggaatacctcttgtaattcatggatctttcacattggagcctttccttgccccgtgccctttctcccctgtggtggcagacagacagagccatactccagtggtctgttctggactcagctgagcagcccgagggcctggatttgactttggaattgtattttttactcgctgcacaggcctagaagctaaatcagctaagtatagattaaaagccaccaaacaagttttcaggctaagaaatatgttttcctagtagaagaatttcttaaaagaagtgtggatttgtctggtgaagaatggaagtggaagataggaatttactaatagtcgctgcagctggcttcaatgttcttgaccttcaaaatgatcatgtctatgcccttcacctcctgttccttcccagtccttatctgtggaatgaagaataccaccttctccttttttaaagctttctttgtatctcttagaattggtgcaggagctaagaaaatctcttaaaacataataataaaaaatgctttatgaacgctactgtctacctgtgaagcaaaatgattttctctcatagctaccatccttttaatggaagaaaagcatgtatttggatgcagagtcaatgcagttctctaaaccataaatgaaggtaaaaactcagctataggatgctcatcctggaggagtagactatatattcagcaatgtgctatggatgagctgaaggtgccattagaaacagcttttaagatttccgattaagcggtcatctcaatgtaaatgacctagcaaggtccctagcaactttcccacaaaatgagaagtttctgtgaaaatgttgttacataagtttacattcttgattatatctatttatatttttttaattgtatttatttattttttttgagacaaagtctcactctgtcgcccaggctggagtacagtggcaccatctcggctcactgcaacttctgcctcctgggttcaagtgattctcatgcctcagcttttcaaatagctgggattataggcatgcgccaccacacccggctaatttttgtatttttagtggagctggggtttatgttggccaggctagtctcaaactcctgagctcaagtgatctgcccaccttggcctcccaaggtgttgggatttcaggtgtgagccactgcacccaaccacatacttgattatatttaaatggacaggaaaaaaatgtaaaagtgctagcttaataatttggattttgtgtatgacttgttcacatgcccttatatatagttaacgtctcttggaatacttaaagccatcttacgaggacattgggaaggtcctgtctatataaggatctccttttcacatgattactgttttttggtttttgttttgtttcgttttgttttgttttgagacagagtctggctctgttgcccaggctggagtgcagtggcacgatcttggcttactgcaatctccgcctcctgggttcaagcaattctcctgcctcggcctcccgagtagctgggattacaggtgcccgctaccacatccagataatttttgtatttttagtagggatggggttttgccatgttggccaggctggtctcaaactcctgacctcaggtgatctgccctcctcggcctcccaaagtgctgggattacaggcgtgagtcaccgctcctgcccgattttttttttttttgttcgttttttaagacagggtctcactcttgtcacccaggctggagtgtggtggtgtgatcgcagctcactgcagccttgaccttctgggctcaggtgatcctcctacctcagcttcccaagtaggtgggactacaggcataccaccacatctggctaattttttgtagagatggggttttgccatgttgtccaggttggtctcaaactcctagactcaagtgatccgctcacctcagcctcccaaagtgctgggattacaggcgtgaaccactgcacccggccaattactgacccttgaagtggacttatgggagtagaaattctttcattccacaattagaaaaaaggctaaagcataaacattttttagaagactttagattgcatatgttgcaaaggaaattatgaaatcaataaataattctggtatttttttgtatacaaactatatagccatgttccacaactctaggaagtaccaaatatgaatggtcaccctggagttgggccagcatggcagcatctgttgggtgctgttctctgaagaggctccagatagaaactgtttttttttttttttttttttttttgagacagagtctcgcagtctgtcacccaggctggagtacagtggcaaaatctcggctcactgcaacctccacctcctgggttcaagcgattctcctacctcagccttctgagtagctgggattacatgtgtgtgccaccacgcccggctaatttttgtatttttagtagagacggggattcaccatgttggtcaggctggtcatgaactcctgaccttgtgatccacccaccttggcctcccaaagtgcttagattacagacgtgagccactgcgcctagccctagaaacatctttttctaagaggaaaacaggctgagcacacagaggcctttagggcttctgcccttggttgtcttctatgaaaatccccatgggccttcctgattcctgccttcgtgacactgaacacctgtggaagtcctgttctcttactagggactgagatttggtttaaggtttttttgtttttgtttttgttttttcccctcatttcttaatgacatctgaactcaaaggttacttctgtagcatttcctcacctatgtgctgtgagggtagggtggtgatttcttcagctctccagggtggatgggaagggccttagctggccggaatcacccctctgggctgatggccttcaacaacctttggcctccagcagtatgtcataaaaataactactattttatgtgtgcgccattatctgaaaaaagctaggtggcactaacttactgcatgtatttatccttctgtataaagatgttcaacaatggctctactttagggaatacttcaccttccttgttagagaaaggaacatatgactggcaaaggaaactccaggataattaaaaacccttgtatgtgtcttcatttcacacattctttctctaggacttcttttgggaattagaccttgaaatagctcagacttttaaagatagagctgaaagttctattatatctagaatgaaaaagtccagtctaaatgaagaaacaatctttttgagggaatatataacttggggttgcggctattatagagtaaagggtaattagacttgccttcctgtcatagacaactctaacattggccaaaacatacaaagtggctgtttttaggcattggacaatacatatcacaagaatgtgatcctggagacaagggaagcataaaagtgagttttacatcaaccctggctttttgcctagaggcactttctaaattgcagcacagggcagtggagcccaaacaaagagtagcagactcatttattggatagaggaaacaagctgtaattcaggactgctggggtggctcaaattttcagggcagggaactgcaaaagaatgagctacacaaggaaagagtgtcagaaatgtatagatctagatgatttggccaaatactaagccaggcatcagtagggcaagactctacgaggcctggcagaaaataagaacttggaggggctgtgagctgagtggatatcccagagatcaccagtaatgggagatgttagagttctagctaagcagagtagaaaaacacgaggtgctatcctcgtgttgagaacttctggcatccagttgagaacccagaaaagccagccacaggaacagcactaccctagacccattgtaacaaagcctaaaaacccaagccttgaccagtcaagctgacctgcaagtaacctgcctaccatagcagaactcaacactctttcagggaagacaacaaaatccagtctttgaacaacagcatgcacagttgctcagcaactgttgagataatataatcgcaaatgactagatctgtgaagaagcaggaaaatgtgaggtggcttgaagaagacataggggtgtttctgagtacagttttcaggcattgatacctgcttcagttaatattggcatccccaagaggaaatgtgtttactgtttttttgtgtgttatccacccagtttcttgttgctagttatatagtatgtaaaaagaaaaaagcaaaagttagtatagcaaagcctgtaaattgttgcctgctaagaagccaggattttttgtaagtagttccactctgggtcatgacttcgttgtattacaaaagagtgagtgactgccagtcaggcgtggtggctcacacctgtaatcccagcactttggagggccgaggcgggcagatcacttgagtttaggaatttgagactagcctgggtaacatggcaagaccctgactctacaaaaaattaaaaaattagccatgcatgatggagtatgcctgtagtcttggctgctcgagagactgagtggaaggattgcttgagcctgagaggtcaaggctgcagtgagccatgatgtatttatccttctgtataaagacgttcaacaatggctctactttggaatgccactgcactccagcctgggcaacagagtgaggccccgtctaaaaaaaaaaaaaaaaagtgaatgactgcctaagccttagttatcctgtgatgttggcatttggaatgtagtgttttcttgagtaagctcgtccctaggactgtctcctcaggcttctttctttacttttggcctgccaggcattgcttctgacactgaatagtagtcagtgtagtcctcgttttttcttcttaccttataaaccatgatatgtggctgagcctcctttagtaactgatttatggggatgtagaaaattctgagagaaatcccagccatgcagaataattgcatctcttggggaggtgttaacaagcagaggcagagatgagtgcttctgggccccggcttccatggaactttcgctcaatagcccccacccctaagctctatgcagaaggcgttcattagcaaatattaaatgcctgtttccatactgctggtggatgctgagggtgtgaggccctctgggggcatgctgaggctcacttaacagcctcacccaaattgtccaacactcattttctcctcaaatgatatcagggaaggtcatgaagaacagccatgctggataacttctgggaaattgggactggggagcctgggggcagctgaccaccagaagtgactgagcagaatacatttctttttcgtttgcatcaagtggtgtacccatttttatgttttcagtttttggtttgaaatgtctgtttctaagctgcatgttcccatttgaactcaaagaagacacttacaatgcctgagaaaatgtagccttcctttttggggtaattttaaagtttttgccacaattttgaataaataataaattcagaacagatcagcaggtaaagcctgatcatatagatgaagcttcctttgtgtaggaattctatacctgcttcccccttgttcagtttgacctcacttctgatgtttgaaagtggagagaagtggaacaacagtctggaggaagattgggtcattcatctattcagtcaacatttattcagaattgacatgttccgggcactacggcaggaattagatggagacagaggtgtgaagataagaatcctcattttcaaggagcttatcgttttcaggaaccttgtgactcaaagtatggtccacggagtagcggcattggcatcacctgggaacctcttagaagtgtagaatctcagacttgccccagacctactgaatttgaattggcattttcacaaaatccctaagtgagaagcatgcacattaaagcttgagaagcgttcctcttaaatcactgattctcagcctacacactggaaaaacctagggacattgtaaaagcactgatttcctgtgcccattccccacccccaaattgtgatttaatgggtatggagtctggcccagacatcggcattttcttttaaattcccaggtgattctaaatgtgcagacaggtgtgagagccactcatctagtacatggctttgtactcttgacaaaacagcccaagatgagattgtagctcattctgttaaccaatgtacaagctaggtggcaagtttgtcttttctacagatttgaagtgcctagactagaggtaggcacaccaggtctcacgtgccctctctgtgcccacaggttgtatgtcagggagtcgctctcagctgtgtggagcacttcggccaggttacacggggccatgctggcaagattgaacagactgaggcccgatactgaagtctgggcaaggcctccttcctcagacacaccccggggccttggcatccctccccttggaccccctccaagtgtgtgagctgctgccagggggtttcacctgaggcagcagggactaggagtggctccttggcactcgaggatggcgctgggtcgcatgacaaatgcacatgagtgtaattaagcagctctcctggtcacattgtccctcagggattcggaccaggccatataatcacgatgatgacaataacaacaaccagctcttgtgtcactctttatactttgcaaagattttcacatgtgtcaggaaaccgagatccagggagctttcgtcactagggaacagcttaagtgtcacatggcccatgcttgctctgttccacctctctctgagttccacttgaacatgtcaggcaaaataaggaatggctcccttgtgacaaagtgagttccctgttataagcagtatgctaggagggagtagataacctgagatgtagcagaacgcagaggctggactacacaacgcctaatgctcaattcattcattccttaaaaggaaaaacatcatttgcattttatagggaaaagtatatgttaccctaatatctccctggtgttgaggcatagagaaaccattttggccattttaaggacttgagtttgaaagagtaaaaatgatatgtcagaaatatgatttctttccatattcttgctaagggtttaggtctactttcccctgagttcatgccaatagagcttatgtctaaacagcagctttctggaagcgtcatctacatgctgctccttttctcatttctacctcccacctcattcagagttcatcccctcacctgcctacaatgctctttctcatttgtattagagtctaaaactccatgaaggtgactgtcgtctggagttatgcctggggtcctggtgtaatttattaatagcgccccagatttggaaacaaattgtagtacttgggccacgttacctctctcctcagtggtcagctactgcctcaccatcctgccttcactcaacttctaccgtcttccttggggacatccacttccgccctgatggcagtcgggcctcacaagcggttgatcacctgcccctcctttctgcccctgtcactcagtgggtgctgtcttgcctcacacctcatatcactgttcagtagatgttggaggggcagggtttgttccaagctctaattcctgtatattctcttccatgagcacagctttcctctctccctcttctcttcctttacgctcagcaagtctgcccttgaccattctcattgcctcagttcttgtccttgttctctgcttccaggctgcccagcttgtcttggtcccacttgtttgtaaatccattctagcacttctgccagtgtttctgtgccattctgattcactgtgtctgcctctcccactagactctgagcttgggagccccacaaggacatgatggttttcttttctcccctggattcatctcctgtcctgcacattttagaagtctagcccagccattggcatttttttttaaaattcccaggtgattctaagtgtgcagccaggtttgagagccattttaggttctcagtaaataaactgaggccaggcgctgtggctcacgcctgtaattccagcactttgggaggccgaggcaggcagatcacctgagttcaggagttcaagaccagcctggccaacatgatgaaacctcatctctactaaaaatacaaaaaaattaaccaggcgtggtggcaggtgcctgtaatcccagctacttggggaggctggcgcaggagaatcgcttgaacctgggagacagaggttgcagtgagccgagatcatgccattgcactccagcctgggcaacagagccagcctctgtctcaaataaacaaacaaataaatagaatttgctgctattttatactttcgaaagcacagccctcatacaagtctcttcatctctgccatcaaaagactagttcttttgtctggtttgttgaagaggacttattttcacttctcattttgctgttaaaattattcctatttcccttaaattagcttgtattgctgggggaaaaaaatgccttgcttctctgtaaatctctatcccactccaggcatcctgaccctgtgcccactttctgtcttatagcagactcttttctttggctatttttcttgttttttttttttttttttttttctacttctgctagtagcactaaatcacactggcagttttctcttttgactgtacttatctcatccatggaccttgtgtttattcttgtaccaatcagaacaattagacatattgtgttctcccttcatgcttcccttctcttctttgaattatgcaatgagtagcactgttagtgttttccttaagaagcagaatatagatgggccatccaagccagtcatcaccaaggggaaatatgagacatacaatgtcattatgtaccattttctcccgtaggggtgtatgggatctaaagttattctgggccgggctcggtggctcacacctataatcccagcactttgggaggccaaggtgggcgaatcacctgagtccaggaattcgagaccagcctggccaacatggtgaaaccctgtctctactaaaaatataaaaattagccgggtgtggcagtacatgcctgtaatcccagctacttgggaggctgaggcaggagaattgcttgaaccagggaggcggaggttgcagtgagccgagatcacgccactgcactccagcctgggcgacagagtgagactgcgtctcaaaacaaaagcaaaaacaaaaacaaacaaaaaaaccacaaaaaaaaccaaagttattctggatgggcttttgctcattaacattttctatattgtttttctcacatgtgaagcaaaaaaggttcttgggttattatttgcataagactaagatgaagcatggatttacactgtttagaaagtttgagcccaggtgtggtagctcgcacctgtaatcccagcactttgggaggccgaggcagatggatcccttgagcccaggagttcaagaccagcctgggcagcacggcgaaaccccatctctactaaaaatatgaaaaattagccaggcatggtggcatgtgcctgtagtccaagctactcaggaggctgatgtgggaggatctcttgaacccaagaagtcaaggctgcagtgagccgagatcatgccactgcactccagcctagacaatgagagtgtgactctgtctccctgcaaaaaaagatagtttttttttgaatgccttttgtgggcatagttctgtatcagatgacctgaaatgaatgtggaaggaagaccagtcctcagctaagcaaaccattcacacatgtaaagatttcagattattgcaaaaactgttaatggttctctcctcttttggtactagagcactcatttgatccctgttacccaaaggaccttgcgtaatattgtatgtctgtctttcccatacatctctaagctccctggggttagagatcatgttctctgcatctgcatgtttaaggtttggtgcttacagagcttaaatatattttgcatttaatagatgtttattgaattgaatatcattaattgcaaattaacactgtactgagcattagagaaaagataaggcattcatcatagtcagtttcttaaaggtgagtttcaagttgagttttgaagaaacctaattccaagagttagggtcaaagaaattctactcccagcttccttcataagtttttctgttatcattgataatgtttgtaacatcctagggtcagaagaacctcaggagccaccaaatcctgccaccactcctgttcataaatcccttctttgaagactgatgctagtattcagggggtgatgtgacatgggcaggaccagactatctacttggacttctcaatgtcatttttccagaaagataagcatcctttcatgttgaaagacttttggacccttgttttgttctgggtaaatctgaacttgatacttcaagggtctttggttttttttgttgttagttggggctagaatttatagtctgtgactaaggactgatttccaaaatctgcactctcttccctaaggaagaccctaaggggtcagcttatctttgtaacagataccactggggcagtggaaggtggtgatgaattacttgctacctgaggtgggccttatgctaacttatagagaattcccacgagtttaggcagatagaggccatcctgttctacagtaattcaagtattggactggaggagatcgcagaactctcagggctagaaagagtctgcattgattctacaaatacttattatatgaggcattgtgtacatggctgggggtataatggtgaaaagtcagatgtgctcctcaccttgctggaatgtatgatctaacaaggtacaaatgagccatacaagccatggctctcccagggccctacagcaaggccttaggccagctgcacatctggtacttgagcccttttctaatcccactggtgtcgtggagaccatgggttctccatgggccctgaacatgatctcctctctttctctgtcaccttcttgctttcccttatgtgttatcagcaggtttttttgtttgtttgttttttggaaagccttttctcattttgggcttcagctggaagttgttgatcacgagacttgggagtctgctataggacaaaaagcaggctcagggtcaggatgcctgaagtgggatggagattaactgattacagggattttattcaaggaattttatatttgacagtggtgtgtatattatatatatactgggcaggaagcgttgcccaagtgaggaggtttacagtaggctggatgagccctgggtcaggcggtagaagtggaattggactcggaggacaaatgtgagacatatgataaaactccagcaaatgggacttccaaccagttgaaaatgggaaaaactagaagtggttttgtggcatgagattatgtgcccaggagaaccacgaggccattaggctcatgagaaaggccaggctcttgccatttttgctcgttgtcctttctctagcacctggctcagtgtccagaacaaagtagatgcttgataaatgtttgatgaatgaatgaacaaaatagagattatccaaagggaagcaagttcactctggaagaatggagagccttattcattcatttaggatgccaacattgcatcctgtaaagtggaggaagggattttcatgatggcaactgtgcgccatcaacatctaaaggagaaggtgaaggagagcagtgcattaatgagcttgtgtaaagtatgatttttcttctggttggctgactgtcacaaaaccttttttcaatattgacaagctttgtgacaggctaatcacatttgtgcatgtgatattttctaagccatatttgcagttaatgaaatacttttatttcagtaaaattaaaatgaagaaaacacatattctcccatccttaaagaaaaaagaaaggctgggcgcagtggcccatgcctgtaatctcagcactttgggaggccaaggcgggcggatcacctgaggtcaggagtttgagaccagtccggccaacatggtgaaaccccgtctctactaaaaaatacaaaaattagccaggcattgtggcacgtgcctgtaatcccagctgctgggaggctgagatggaggaatcgcttcaacccaggaggcggaggttgcagtgagccgagattgcaccactgcactccagcctgggcgacagagtgagaccctgtctcaaaaaaaaaaaaaaaaaaaagaaagaaagaaaggtaaaagaagaccttattgattcagggcatctaaaagcagcactgggttttgagtaccagccgacattgttaagcggacttaagcttttgttttcccctctgacattggggtttgtgctgacttggtaaccattgcctcattaacacggacctccaggaaagggcctccattctcttgaagaggggggttacacccctctggaggctgcttgcccccatctctcactctctgttctcctgttttctaggactgcatcgacgtaggctggtgggaaggagagctgaacggcagacgaggcgtgttccccgataacttcgtgaagttacttccaccggactttgaaaaggaagggaatgtaagtctccttcactttgatttcagcggagttgtggctcccatgttgggacttgggatgggggaagtttggtgtaatgttgaagagcactggcatttgaacattcaacagacccagattctgagccctcggctgccatatactctgtaacaagtttcatcataggatgcatctgttagctggcaacagtgatctctactctgcggttgttgcatacataaacaagatagtgtgtgtaaagcactcggtgcagcactggcacatttcagcacccaaataaactgtgagaaccttgggtgctctttttggtaagtggactgccagcatcccacatagcatggtccttgggggtgggaaagtagccagtgttgtggaagtggttgaaaagcacattgtaaggctgaggatgcagggcgaggcctgttaatctttctacactatatgcttacatgtgtgagtacacccgcacatatccgtatattagtatatacacatctctcatccacggtttctcttttgttgtgggagcccatttgaccatgccactgtttaaatcagccactccatctgtgtttgcctcactccaggtgtattctttccctgctgacgatgtaataagaaatattgggaagttagaagcactttccagtataagggaggagcaatcccatatttaggttctttgcccaggcttttgcgtggcctctgcccacctttcccagcctcaacccacttcatgtccatggggactctgttactggacggtgctgagccagatcttgccatggcacgattccagtagggctgaggtgtgggaaggatagctacagtgctggtggcttcgttgccaaggatactaaagtagcatttaatggaatttgtgctgctttgatgaatggatgtaattgtttaagaagctagatggtgttggcgcctgccaagattacggcccatagaccattaggttggtttaaaggctaagttagccacactttgtaagctttttgattgcttgctttcttgtattgtttaggtgaaggatgttctgttccacacctgttgttctctcttggagtctgagtttgggttctagagaatctggattctggttcttaatgtttcctagattcttgatgcttaaagtgagatccatggaccggcaatagcagcatcacctgagagcttgttagaaatgctcagaccccaccccagacatggtgcatcagaatctgcattttaacagcgttctctggtgatttgcttgcatattacagtataggaagcactagtgtagaagcaggtatctaagtgatgacaacccaccttctggtttcctcccccatcccccatattttaggagggaaataaattcacacaacagagaagagctcatcattcaataaggaaattttccaccaagcaaaatcacttgaaatgtttttactgatgactgtagcaatagtggattgtcatttgacaaaatcagtcactgagaagaaaagatactaaacacttagtagtgactgcataggaaatgttttgaaatagtaggacgcaggagtaaggatggcaaacattacaaagagtacagtggttgtgaccctaggctgtggcatcagatagatctgggtttgaatcctggttctgtcacttacttgttctatagccaaacccgagtcactgaatgtctctaagcctctgcattctcatccataaaatcatgagaataattgtacctaccttgtcgaagtgttgagagaagatttactgggatgatgcacataaattcttaaacatggtgcctagtagttggtaaatgcctcacacagattaactattccagtctttataattactatttaccacgagggtaggaagactctagctaaaactgtgaagtaatgatagaaggctgactctagttctttttgctccagctcatcaaatcaacacagttatcttggtatcttggcgagcttccctaggaatccaaatgcatctaaaaactttgataaatagccattagaaataaatctagcaacttagaaaatgtattggtagagacacgtgagcacagaatggcataatctttatgttatttgtcatggtttttttttctggatctgctgcctgataaatgttttattttcattcactcattcagtatttattgagtcctttctctgggctggccactgtgctggttgattgaaagtgaagcgtgcacatgggtactgtccttgtgagcttagagttaggcagttaggtctggcgtttagggccatggagacctgccagactcttctgaaaggacacttgatataggcctctccaagtgagtggaggcaagggggctgttcagtctgcccataccccgcttctcccctatctttgtgaggctggtaaaagctaggcacatcctgaagcatttgggcgccaagaccttcatggtgactcctctcccttcgaccaaggaatcttagcaagcataccatcttactagacatttgccaccttattggttctgattgaggcagtatgtttttttaattgacagataaaattgtatttaatgtttacaacgtgatgcttttaagtatatatacattgtggaatgactgaatctagctaattaccatatgcattacctcacgtcgttatttgtgtggtgatgggcagtagggttttgaagactagggtaaaatctagatcattcttttaacaaatgggtaaagcatgccttctaattcccagtcatgtcttgggggggggcagtaaattcactcaggtgagagctactccatacagtacttttctagaagctctgtgttacataagctattaagggaagcacttccaccaggagagtgaagttgtcagtgatgagtggactgggcatggcacgctctttgggacatgcacgctctctggggccccatgggcatctctctaatcccccacaagcagccgccatctctttgataagtcttttaaccttgtccttatgaagcagaaaacccaatttaagggaaacaatagtcatacccgtcagacaaagtaatacctatagctgaaaagtgattgtataacctaacatttaacttccagaaaattcaaagtataacatcccattccatctcctctggtctataaaaaccagccaaccatcttcacattggttgttataccagcctttattgctgcacccagagtattggtgagttggtgacaatgcgactggagatagggctgtcatttgctgcgctgagggtgtgaagatgattagaatcattaacacgaaggcactatgtgaatgctagagtctgaaacgttctgccactggtgtcagcagatgtcatcttgtcttgccagtgactggggttacaatcattcacccagaaaagaggacgatctgtgatgattagggtagacagaagcaaacggcatttattcaacagcaggcctcttgactccgtaggcatccgcagagcattctgataaggctgacatattttctgctggggtgtgaattcaggtagttactacaaggccttttggaattcctggccatctttctttcggagagtgcttagtggattctccctcaccagggtaacaaatgctttggggtttttcctcaagatattccagaagagcatccgttgatctcttggtgcatattttagagcaattatgtaagctatttataagagaacctagattcaatggctgtctgtttatttttggccttgacagtaaaattgaataccagaacggaaagattaaatattctgagaactctaatgaagcagtgtgtgtgctgtgtcattgttacagaaggctaacggggaacttagactctcaaaaacagcagaaacaactgctcactgtcattaaaaaaagaacaaaattagaataggtattttgaaagatagtgttatttaagaaagtggccagtgtggtggttcatgcctgtaatcccagcgctttaggaggccaaggtgggaggattgcttgagcctaggagtttgagaccaacctgggcaacatagcaagacccaatctctacaaaaataagaaaaattagctggacatggtggtacatgcctggagtcccagctattcaggaggctgagtttgggggatcgcttgggcccagaagtttgaggctgcagtgtgctgtgatcatgccagtgcactccagcctgggcaacagagcgagaccctgtctcaaaaaaaaagtaaatctcaggctccagttcttttaagagaaactgttcaaatcaccagaagatattactgatctaccatgcatttatttggagggctcttcagtgttagtgcaagtcaagaatgatggcattgctaagattcccataggcgtttccctaatgaatgctccccagtgggagctcagcctcagggactcagaaacctgccctcgaagatgtccctgtgagtatgatgcaggctcgcctttgctgagtcacagagacttaatcaggtagcaggcagccagcttactcatcacaacaagaactcagatgtcagccagtctggaacgcagaggtctgcctgccccggtcattttgtcccctatgggtctgattccttagaagccgggttccaccagaagccacgtttatccggtgctttccgggagggcaaggaatcaaaacaagaggagtttgttgttcttaccaagggtctggcaggtatcacttgaggctccttcatgcaccaaagggaaagatctgccaagggaaccatgtgttgaagtcaactaagccttgatgatacttctaagagcactgcaccactgccttcggcctccatttgtctttgttttcatgactgactggacccttcctgttcacatcaatctccagacacattgtgatgcaatcagttagatttcccactttctccattataatcatgtgccaacccaccctcttacgattttttttagcacaagttttgcaggttccaaacttttgcaagaaaggaagtctcttgctcgattcccacaatggccgaattttgctggtttaactctaccttccctataccaaattcgtaggaggcccctcaccttacttagcctccatcttctgacaactcagtccgtaaaatctgttcttagtcaacattttctttattattcatcatgtcctttagcctttagccctggccctaatttttatttagaatcatcttaaaagacatcttgtttgaaaacgtggcatctataacaagaactgttgtttttctagtttctgaagatgcccgataatttccctattttttagccttccaaaagaaagaaatatgtgcttctaataagcagccttatgaaaaaaatttacctaaacattatctgtcttgaacatttagtttcatgggtggtttcacatgcaaagaaatggggtttgtcaaggagttaatgtcatctgagtatggcctattgactcagccccagtggactttctcaaagccacccagatggtattccctctcccttctccagctgtacttacagcctgtagtctttgaaggcagagcccatgtcccaagcttctccttcatggggccttacagcatgcatggtacatggttgctggtgaagaacccatggtcctttagttggttggtgccagagtgtatcttctcttcctcctgcctctcctctcctgcttgctgctttctcttgtacaaaagaggaggaagagtggaagggaggggcagggggaagctggcctcctgtcagattgtccttcctagaccaagagaggcccagatccttccatctgatcatggggtctgggcatggaatcaaggcatcactttcagggtggggcagatggaatgaaggggtgagccaaggggtgaactgtgagagcatcttagggagaaaccaaatgccaaggcctggctgaccacccaataggccatcagtctgaatgggagatgatggatgtagaccactaggccagaggctgaggaaggaaactagagaaagactcttccaagagcagattccctaggtccctggggatctccagtgcgggtgacagggcaggcagttgctggggactctatagggtacagaggtgcagtttaagacactgtcatcacctagagcatagctttagctgcacatttcaaaggtgtggctgttcctctaggggcaggggagaaaagggcagagtggagatccccatgtgtttctagagctgcaaaggggtgccctaatcaggagctgtccatttgtgtcccctctccagcctcacccacagacaccgccagagaacttagtgggatgtgtggaggaggtctcccaaagtccagaattgctgaaaatcaagctgagacttacttccagaacctcaccatattcctctaacgaagccctttaaaggttacccagccatcagggtacacttctgtttgtgtttgtttgtttttaccaaatcacatctctggggccagagctctgaaggcaaaccagctcaagaggcaaagtagcaaaccagattcctgccaggggaacagttgagccagccaatgagccttttgcttgggaagggccagtcttgccaagcaaagggcagagtcagttctgaaatccttcacaggaaacaaagcttgtcttcctgccattctcattccagaacgtttatatctatttccttcctggtaatgtaaaggtaaaaatcaaatctagctaatatatcctttgaaggatggtgtctgcatgtcttggtgccagccaacaaccccgcacacaagcagacacagacgcatgtgcacttaggcctgtgctccctccatatatgaagactatggaaggcattcggctctcccagaaatcagaaaatgtgggttcattgactttgttaccattatattcatgttggttcttgtgaaatgaattcccgtagtctggacattgagaaacgtagagttctgggccctctggctaccaactagctgttgaaacagcctttctgggcctcagtgatctcagctgcaggggggactcctgtgatgacttgcagctcttaatatccactgtttttttttagcacttacctgcaaattgagcaggctgaagccacctgaggttggagctggagcattttaccttcaccatggagggagggataaagagaataaacagaacaagtgcctctagaaactcaggacttaaatacttgcctgagttgaaaggatgtttttgggtgtgcacctataggagctggttaatatcttattactgttaaactccacacaggaaaccttgacctactacttagcccggaggaccccagccccattttctttatccagtcacaatgggatgtttggagggaaatcaactaaatgatctcttcatgtctttttatttgagaatagtgaactcctgtgatgaattttctactgtcacattttgctggagaatcacctgttttgccttctcagttcacactgccttgtcttcctgttgcatttaaaaagaaatttttaatttgtttcatttttttttttactgagacagggtttccctctgttgcccaggctagagtgcagtggcacgatctcagctcactgcagcctctgcctcccgggctcaagcaaccctcctgcctcagcctcccgagtagatgggaccacaggcatgcgccaccacgccggactgactttttgcattttttgtagagatgggttttcactgtgttgcccaggctgctctcaaactcctgagtgcaggcaatctccctgccttggtctcccaaagtgctgggcctgttgcatttttttttttttttttttttttttgagacggagtctcgcccactgcaagctccgcctcccgggttcacgccattctcctgcctcagcctcctgagtagctgggactacaggtgtctgccaccgcgcccggctaattttttgtatttttagtagagacggcgtttcaccgtggtttcgatctcctgacctcgtgatctgcccgcctctgcctcccaaagtgctgggattacaggcgtgagccaccgcgcctggcgcctgttgcattttttaaaaaacattgtaggcccatgtgcaatactttatgaatcattttggggagggggacagtctacagccgcatagaaccctggtcctgatttttatttagaattaccttaaagacatcctgtttgaaaatatggcatcttttctcctttgaaaaagcatgaaggctaagtttgatggaaccagagaaagtgaagtcagtaaaggattaaaaaagaggaaaacttgtgaaccccctctgctagtaagcaaagcaggcacctggccagcattgatcaagagtggtagatgcaagacagacagctcacaaactgttccttcctttcaaaactgtgctcccaactgcctctgcaactgccgggtttccgaacaaaacttcacacttctgtctctgtcctttgccacattcacacacatgcttgctgtgaccacactcttcatacactgtctgttagtgcaacattttcctctctccctcccctggtgcccctctgctctgctctgtcacatttcatgtgtctgctacatgctaaatgtgacacaacattaaagggattttttttttctttgaccagtaatcttggaaaatatgatgacttgtaattgtcgtttttaaatttggggccctgtggtttgaggcaaggtcgctggggtaatggcctcagcgaaaggaggctcatgtgaaattggctatagaaaaattcagaccagcaaggagtgaggaagatgtccaggggtaggtgtccttgggacttggctgggaagaataaggccacggggtgttggcagttttgtaaataaggaatgacaggcatacttcattcttctgtgcattccttcattgtgtttcagatattgcgttttttacaaattcaatggttgtggtaaccctatgtggagcaaacctactggcgctattttcccaatagcatgtgctcacttcatgtctttgtgttacattttggtaattctcacaacatttcaaacttttttattattattatacctgttatgggtaatctgtgatcagtgatctttgacattactattgtaattgttttgaggcaccataaactgtgcccatataagatggcaaacttaattgatcgatgttgtgtgtgttctgactactccattgacctacgattccccatctctccctctccttgggcttcactatttcctggtatgtaacaatgttgaaatgaggcaaactaacagccctgtgatagcctgtaagtgttcaagtgaaaggaaaagccacatatctgtcactttaaatcaaaagctagaaatgatcgagcttagtgaagaaggcatgttgaaagctgagacaggccaaaagctaggcctcttgcactaaacagttagacaagctgtgaatgcaaaggaaaaatttgtgaaggaaattaaaagtgctgctccagtaaacacatgaatgataagaaagtaaaacagccttattgccaggcatggtggctcacgcctgttatctcagcactttggaaggccaagatgggaggatcacttgagcccaggagctcgagaccagcctgggcaacatagtgagactccatctctataaataaataaataaataaataaataaataaataaataaataaaaacagacttgctgatgatatggagaaagtttgagtggtctgaatagaagatcaaaccagccacaacacttctttaagccaaggtctaattcagagcaaggccctaactattcaagtctatgaaggctgagagaagtgaagaagctgcacaagaaaagttggaagccagcagaggttggttattgaggtttaaggaaagacaccatctctataacataaaagtacaaggtgaagcagcaagtgctgatggagaagctgcagcaagttatccagaagatctagctttgatgaaggtggctacactaaacaacagattttccattgatgaaacagcctttgattgaaagaagagataatctaggactttcatagctagagaagttgatatctggcctcaaagcttcaaagggcaggctgactctcttagtaggggctaatgcatctggtgactttaagttgaagctggtgctcatttaccattctgaaaatcctggggcacttaagaattatgctgccagacacggcagctcatgcctataatcccagcactttgggaggccaaggcaggaggatcacttgagcctaggagtttgagaccagcctgggcaacatagcaagactccatctctacaaataataaaactggccagttgtggtggtgtgcacctgtggcctcagctatttgggaagctgaagtgagaggatctcttgagcctgggaggtcaaggctgcagtgagccatgatcgcaccattgcactccagcctgggcgacagagtgagatcctgtctcaaaaacaaaaacaacaaaaaaagaattatgctaaatctactctgcctctgttctatagatggaaaaacaaggcctagatgatagcacatctgtttacagcatggtttactaaatattttaagcccactgttgagacctactgcttagaaaaaaagattcctttcaaaatattactgcttattgacaatgcatctggtcacccaagagcccagatggagatgtataagaagatgaatgccgttttcatgcctgctactacaacatccgttctgcagcccatggatcagagtcgtttcaactttcaagtcttgttatttaagaaatacattttataagtctatagctgccgtagatagtgattcctctgatggatctggggaaagtcaattgaaataattctggaaagggctcaccattctagataccagtaagaatatttttgattcatgggaggaggtcaaaatatcaacattaacaggggtttggaagaagttgattccaaccctcagggatgactttcaggggttcaagacttcagtggaggaagtaactgcagatgtggcggaaatagcaagaggactagaatttgaagtggagcctgaagatatgactgaattgctgcaatctcatgatcaaccttgaatgaatgaagagttacttcttatggatgagcgaagacagtgatttcttgagatggaatctactcctggtgaagatgctgtgaacattgttgaaatgacaacaacgggtttagagtattacatatgcttagtgataaagcagtggcgggatttgagaggattgactccagtattgaaagatgttctactctgggtaaaatgctatcaaacagcatcgcatgatacagaaaaatttttcacgaaagaaagtcaatcaatatggcaaacttcattgttgtcctattttaaggaattgctacagtcaccccaaccttcagccaccaccaccctgatcagtcagctgctgtcaacattgaggcaagaccctcccccagcaaaaagtttacaactcgctgaaggctcagatatcattagttttttctagcagtgaagtatttttaaattaaggtacgtacattgcttttttagacatgctatcacacactgaataagctacagtagagcataaacataacttttatgtgcaccaggaaaccaaaaaaattcctgtgactcgctttattgcagtggtctaaaaccgagtttgcgttatctctgaggtatgcctgtactctgattccgaggtaaaggaaggttaactggcagaacttcactgatacttttgttaggtaaacacacatctgtccccaggataattaacacaacgacagagaagggaggaagaaaaagagttagtagagagctagaaggggctggcaaaaggggaaagaataatgtgagatcatgaggcagaaacacatccatcccatggaggacctgtgtgtaagggcaggtggcccttagagcagctttctttattttaataaagtatatttctctgcactcatagagacaatacagaaaaacattaagaatgacacacacacgtgtgcgcacacatatgcacccagaatcagagatcactgcttccccctaacacagctgtctgagaacagtgccctggctggattttttggccatggaataattttccaagtccagcctgatcatctctctcccacagtcaatcctaggtggcaagaaaatgctggctactctggaaccagttcagggatgaatgccattgattgcactgctacctccatcacctacagagtgacagcatgtgagaaaaacaaatcacggctgatatgcaaaaaaaaaaaaaacaaaccaaaaaacaacaacaaaaaaaatccctctctgttccagtttatcacatgtacaatgagtctgtggggtgtctaacaaatggcctgccagcctcggtgtagaaaggggcagaaggcttgcaacctgatgtggctgcagtgggccctcagcctgcattttgttgagagtcctacatccagagcagattcaattttgaatctttacagtgactcttttcgaatgcatggttattcagcagattaaatcttaattgcaaatgcagcttcagcgtaggagtaccattgtgcttgctggtttcaggccatttttgctgagccgtgcttttccagaaggctgttacaaatttagaaagggggaaatggcgtttcatttgtcgattggagttttgttttgccgactggatttattttagtgtttgtttagaggtgccaaaaactgacgtccctggagagagaattgctcaatttttttggagaggttctctaaattgtccaaactgcacatagaaaacaatgtctgtggtccttctgtgagaggacaggcttgccaacaatctcatgtggtataatttttattaatttttcagagacccaagaagccaccgcctccatccgctcctgtcatcaaacaaggggcaggtaatgtacctttcagttccatcaaataaaatatgcgtctttctttttgcatatattcaaatcatcctcagtgtagagttcgggattcctggttcaagtgccatagattgactacttgggaagttacgatttggtctcagcaggcaggttttaaagatacttctgtttttcctaaaagataaacataccattaaaatgtgaccctgatatagtgtaaaaatctaggctcccaatgagaatgatcagaaagaattaaaacaaacaaacaaacaaacaaaaaaaacaagtttgggtttttttaagtaaacagcttttgaggagaaaagaactgaattgccctgtttctcatgtgcccagttgaaggtcagcttagggaagattgtttcccacaggtcatagcattgttgtgcgtatatagtgttgctgaattttcgatatctgtcccatgtggttaaccaaaatttgtactgacttcacttacccctcaacaaaaagatgtttttctagcaataaatacttttccttatgattcttgtttaattttgaagagtctaattcactttttttctgtgtagttcagatattcaggttgaataatataggaagaattgatgttgaacatttggtagcttgtttcacactggattctcatatataaaaagatatttcatatttcccggtagaactcctctttataatagttaaaattaattatagggaaaaattcctccatgagttattagttaagtagcattttaaaaaattaacaactaaaatagaagagaaagggtatttttagttctacacattcacaattatatttctataacagttaaattatgaataaatttcaagattggtttatttataaacttattaagaagtgatttttaagttcttttggcccaccaagttaagaggaaaaacttgaccccaaattcctttcccattccctttggcatagttgagaattattagagattaagtcctgaaatgggatgttaattacatcttttgctccgcccccatccttgtttgcattgagcagtttcattttgccacctagtggttctgcccatatattttattgtgctgaaattgaagcaagctatttatttacttttctctgaagacccctttccctgtaggccttggtaattgatcagagaccgtggagattagttgaggagtccaaggctcaggcagtctagaatgtagctaagattggattcttcagtataataggattgtcagttctttctgtgtctctaggaatgataccgacttcattattgttaggtgagtagattgtagcatggtaggcaaattcttacccttttaaaacaattttaccaaagtttatgatgggtctctgtggggcaaagcaggatggcatttaatgtttatagattactgctcatttatcctgcctgaatgatcgtgggaactgctttgtaatggggagatagatattcatattttctccctcgtcaactttccttgcgtttgattattttaccaaaaaaaaatcagatatgaaattgacagaaatgagatgtggtgattaatttgtagtgagtcattaagaggaattaagtaaaggatgtgtttggtggatattttttttaacttcttttgttctctgaggttgtgtaattgagatttctagtaccaagcacccatctttggaactggtcatgtaaagagtttgttaagaactcagcccagtccatacataagaggagtacttttgactggtttgtgctttagctatttctcaagtgctcttacatgcctgaggccactggcaccaatgaggaaaccccaggtaagggagcagctgcagtccatgtgggtaaaggctaagtgctaagtggtacatttgaaaaaatgtaatacttgaaggaccccaaatttggtggcataaaacaacagccttcttatgttcatggattctgtgggtcaagaacagaccatggctgggctggcttgtctctgctccgtcatatctgggacctcagctgggaatactgaactagctgaagctggaggatccactttgaagatgaatgtttccctcacgtgtctggctccccttggcaagggtgcctggaaggctgggctcagctggggctataggctggagcatctgtatgtggcctctccagggtagttgacttcttacatggaagttcagtattccagcaaataaagcataaactacagggacttttatgactcagctttggaagttatgtggtatcattcctgccactgattgaagcagtcacaggcccacccacattcctggcaaggggatgtagacctcacctcttactgggaggagtatcaggtaattccaggccctgttttaaaatggctacaaaatgggatccagattcctatgaaaccccctttttttggtagaacacaacattcagtggccccttatttgtaaagtttgataattgacatttatttatacacattctccacccccacccggtgatttcctgtgactatattgatgcctaaggaaatcaggcttaaatatcagaaaatattattagtggtattcttgtaaattaaggatacataggcaggtgaacttaatgacataggccagaaatgtcttctgctctgtttctaaacagctcgtgcttgccagataatgctaacgcccaactcaggggaaaaaatcttactgactttgctctacctgataaagatttaaatgctggtgggtgtaataattgagtacagaaaacattttgtgatcactattaccctttccctcctaggcaccactgagagaaaacatgaaattaaaaagatacctcctgaaagaccagaaatgcttccaaacagaacagaagaaaaaggtatgaaatcaattcttcattggcacttccagaacagcaggagctgaagctgtctgttacacggctagtccagaatacccacagaatttgcttttcctttggaatatggtgatcatggttttgttttgattgcttttacaaatcctattgctaaggaagtaggagagggttatgtggtacttcgtgggaccacaatttctcatcagatgaaaaataaccagtctagtcaattaacacattgctgctgtttcctgatgtctctaccatggccaccctctctgcaccctgaagtcggatgtaagttcctttagggcctggtatatatctgtcagtttccacttagcctgtccttcatgcctagtgtcccaaggtgctcattcactgttgatggatggatttggcatagtgaaattcacgtccagataaataaacaaatgaaagctcttttctttggtcactcatggacccttgactctgggtaacgttattacagacagaagtccttggtcaaggatgttggaggaggggagggtggcatggtaatactgggaaagcagcttggtccccagcgtctcctgaaggtggtcaggagtgtcattggcaggaaagtaggttaatgtgtgtcctgcaatcaggtttatgaacgcgtttgactcctaccattttgagagtctctcccaaagaattctgcatactgtagaaggactcattttattaggtgtctaggatttgattgatcacacatttttatgggaaaagtgctatgttattacgaacaggaggctgagcaaatcccattttaaaaagcagttatttttaagtcacaagagaaatgctgaattaatgaatgtaattatttggaggtgctccttggtggcctcatgaaattttattgtgaaatttgatatttgatatcagcctgccaaaaattttaccaacattgccagctcttaagaagctatacctctttctttcacagtgagcagttagaacttgacttgtggaacctcattgtgaaggccaggtctgtgtcacggattgaagaaaaaaaccagccattgagtatatactatatgaataactctttgtataaaagcattggtatggccaggcacagtggctcacacctgtaatcccagtactttgggaggctgaggcgggaggatcacttgagcccaggagttcaagaccagcctgggcaacataacaagaccctgtctctaccaaaaaaaaaaaaaaaaaaaaaaaaaaaaaaaatagccaggcctggtggcctgtgtccatagtcccagctactttgggaggctgaggtggaaggatcgcttgagtctggaaatcaagactgctgtgagctgtgaccatgccactgtactccagcctgagcaacagagtgagaccctgtctaaaaaaaaaaaaaaagtgtgtgatgtgaaataaccagacaccaccctctgtcctcatggaggacacatggctagtttctgggtaatagccaggctccgtgatggggacacttcctgcactagtccatgctgacatatggactaggcttacatgtgaacaaccaccctagttggctgaccaagtggccccacatctctggttccttcctctcccatgatcccttgttatatgccacagcgggtgagggacgtagaatccctggtcagatgcaatagggaagccagggaatcagccctacccggatacttggtttccctgttgggtcagcacaaactcccttttccattcatccagcaggctgctggagttcctgtccctgtcctgctgcaataggagaaatgtcccctgctttgcatttcaacagagcccttcctcctctggcccctgtgtgccataaaatgagttgccagcattcctgattggagcatatttccccacattgtggggatgagcataatagtacctgatgggtttatttttattttatttttttagagacagggtcttgctctgtcacccagcctggggtgcagtggtgcgattgtagctcactgcagactcgaactcctgggttcaagatcctcccgcctcagcctcccgaatagctgggactacaggtgtatgccaccatgcccggctagtttttgtagagacggggttttactgtgttgcccaggctggtcttgaactcctggcctcaagtgatccttccgccttgccctcccaaagctctgagattacagatgtgagccaccgcgcccagccctgatgggtttttttttttttaaccttttgccaaccatctgggcacccaaacaacatgagtctgtgtttgcaagtagaaggtgtcctgagtaccatcttacaagtaagcatagggagcctgcctatagtccgttgggcaactctctcaagttccatctttatcaagaagaatgtggatgtatgctttttatgccacacacggagcaaggctagttgggaacagaaaatatgaggttgtcactgaacactgcccccgttcggccaacagatctggcttcaacttcattctaatatctgtgactccaaaaagccttggaaaccttatacctgtgaagtcctagtttgccttccaagttcaaacttcttgtgcgcaagaagaatccagaactcattgttccctgaaatgctctcccttttatttgctcatggcccttttcagaggccagcctgagacgtgtcaggcctctttccttcccatacccagcaggtcccgtgggccattgaccaaacccctcagccctctgctgagccctgactccatgccagcaccacatacagctctgaggagatgaccagacttgggccctgccctcaggggctgtcggcctacaggctgtgccaaacatgcaaacacccagaaagtgtctgagcgtgtttgtaaagcgctgccctgtaatgctcaggtgaggaaggaaggaagtctgcctttgagctgttgggaagggaacatggcagtgtcacgtttcagccaggcttcgaaggaagagctggagtatgctgaaggtgggcggtggccagaagggcgcttcaggcagaaggaccagcatgagtgaaggtgtgcaagggagggaacagtgagctctgtgggacttcttctaacctgacaaagaataagtggtgctcttggccttccatgatcaccttcagaaatagcatcagtaattttttttttttttagcaggaaatgagtgatctgcatctaagtactgtcacttacactcgatctatctgttttctttaaacaatgatttaaagaaagaccagagagagagccaaaactggatttacagaagccctccgttcctgccataccgccaaaaaagcctcggccacctaagaccaattctctcagcagacctggcgcactgccccc

SEQ ID NO: 3243 - DNA, 353636 bp, human; identical to SEQ ID NO: 3219

SEQ ID NO: 3244 - DNA, 209997 bp, human; identical to SEQ ID NO: 3220

SEQ ID NO: 3245 - DNA, 134172 bp, human; identical to SEQ ID NO: 3221

SEQ ID NO: 3246 - DNA, 136991 bp, human; identical to SEQ ID NO: 3222

SEQ ID NO: 3247 - DNA, 171687 bp, human; identical to SEQ ID NO: 3216

SEQ ID NO: 3248 - DNA, 264058 bp, human; identical to SEQ ID NO: 3217

SEQ ID NO: 3249 - DNA, 353626 bp, human; identical to SEQ ID NO: 3218

SEQ ID NO: 3250 - DNA, 72647 bp, human; identical to SEQ ID NO: 3240

SEQ ID NO: 3251 - DNA, 299181 bp, human; identical to SEQ ID NO: 3241

SEQ ID NO: 3252 - DNA, 107017 bp, human; identical to SEQ ID NO: 3242

SEQ ID NO: 3253 - DNA, 353636 bp, human; identical to SEQ ID NO: 3219

SEQ ID NO: 3254 - DNA, 209997 bp, human; identical to SEQ ID NO: 3220

SEQ ID NO: 3255 - DNA, 134172 bp, human; identical to SEQ ID NO: 3221

SEQ ID NO: 3256 - DNA, 136991 bp, human; identical to SEQ ID NO: 3222

SEQ ID NO: 3257 - DNA, 264058 bp, human; identical to SEQ ID NO: 3217

SEQ ID NO: 3258 - DNA, 353626 bp, human; identical to SEQ ID NO: 3218

SEQ ID NO: 3259 - DNA, 299181 bp, human; identical to SEQ ID NO: 3241

SEQ ID NO: 3260 - DNA, 353636 bp, human; identical to SEQ ID NO: 3219

SEQ ID NO: 3261 - DNA, 264058 bp, human; identical to SEQ ID NO: 3217

SEQ ID NO: 3262 - DNA, 353626 bp, human; identical to SEQ ID NO: 3218

SEQ ID NO: 3263 - DNA, 299181 bp, human; identical to SEQ ID NO: 3241

SEQ ID NO: 3264 - DNA, 353636 bp, human; identical to SEQ ID NO: 3219

SEQ ID NO: 3265 - DNA, 353626 bp, human; identical to SEQ ID NO: 3218

SEQ ID NO: 3266 - DNA, 299181 bp, human; identical to SEQ ID NO: 3241

SEQ ID NO: 3267 - DNA, 353636 bp, human; identical to SEQ ID NO: 3219

SEQ ID NO: 3268 - DNA, 353626 bp, human; identical to SEQ ID NO: 3218

SEQ ID NO: 3269 - DNA, 299181 bp, human; identical to SEQ ID NO: 3241

SEQ ID NO: 3270 - DNA, 353636 bp, human; identical to SEQ ID NO: 3219

SEQ ID NO: 3271 - DNA, 353626 bp, human; identical to SEQ ID NO: 3218

SEQ ID NO: 3272 - DNA, 299181 bp, human; identical to SEQ ID NO: 3241

SEQ ID NO: 3273 - DNA, 353636 bp, human; identical to SEQ ID NO: 3219

SEQ ID NO: 3274 - DNA, 353626 bp, human; identical to SEQ ID NO: 3218

SEQ ID NO: 3275 - DNA, 299181 bp, human; identical to SEQ ID NO: 3241

SEQ ID NO: 3276 - DNA, 353636 bp, human; identical to SEQ ID NO: 3219

SEQ ID NO: 3277 - DNA, 353626 bp, human; identical to SEQ ID NO: 3218

SEQ ID NO: 3278 - DNA, 299181 bp, human; identical to SEQ ID NO: 3241

SEQ ID NO: 3279 - DNA, 353636 bp, human; identical to SEQ ID NO: 3219

SEQ ID NO: 3280 - DNA, 4595 bp, human
taaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcaggtagatgctgccaccgtgccttggctttcccaagacggttctcctcagacccaatccacgtgccattctctcatgttttggggagggaaagggatttttctctggggacaagtgcatcccctcgtgcagctttcttgggtttgcacgttgctcctgagttctttccttcagtcttctgagggtcccctggaggaaatctagaggctgactccactcatggctgtggaagctcacggggatgctgagtaaaacaggcctgcatctgcacctcacgcaaaagaagatcttcctttagactttcaggcttctatgatgcagtgagttcacccagatggtggctgctgtggcacttgctagtgaccttgtctttcctcctcatgtttctattgtcttccactgtaaaatgcgtccagggttccagccagcccatgacagcttctcttgcttggtggtcgattgtgctagtctggacggcatttcccatcaccacactgggttggattttttttcacttccaactggcagctgctgtgtgagtggaatcattatattcgtttcccttgatcttttcctcttgatgcctctcctctggtgcagccttggggaagcccacagcaggcaccactgatgcaggagaggctgcgaagatcttggctgaaaagagaagacaggcccggctgcagaaggaacaggaggagcaagaacgactggagaaggaagaacaagataggtatgctagtgctcagaatttcggtgtgatctcatgtaactgttgtgttggaaagagcagcttgcctttctttttacagcgttggtattgataaaacttgaacagaagtatgggaacctagaatgtctgaactacatggaaggtgttcaggagactgagtcttatattagatgtaattattaataacaatggaactttgttcttttcggaggacctggaaactcatagctcttggatctaaatggcacaggcatcttcccattctcctcttggactttggggccaggcaggcctcctagagctatcagggaagtctgaactttgtttaaaaaatgagattctccctgggaaaacaagaggttcaagattctggttttggtcttgattctgatttccaaattgtttcctccgtcaaattatcctaactcacaccccaaagtgagagacagaggggagggttgagcagtgtcccctaggcatagggttgtgtgtaggggcaaccgcatagtctaagaacagtgaggtatggggagtcccatctgggagcaagacaaaagacatcattgcagtggtccctacaccttgaagagcatcagaatcatccggggaatgcagtaaaaacacatggactcagccctgttctgttttagtagcttgccagggtttgagaaccactgtgatgttagtaccagggtactttgtcacaatacagacagaccttccttttctgatctttttatttagagaggaaagcatgttgaaggacaaggtcgattttatcattaaattgataaaggaagccgttaggctcatcacagagtacaatccaatactgtttagagaattatcatgacaggaagcaggcaatgctgtagcacttcaaggccagcaccgaatttagagtaataaataatagaatattattgatcctttagtgaccttggtaagtctttgtggtctctgattacaggtttgctgatctattttttaaaagggacagtggggtaggtctcgacagtcccttcttgaaatttgggacttctttgattgttttcctgtttccaacattttggtcaatacagacgtgttttgtttgtttgtttgtttgttttgtcgagtggcatgtttgggctggtttgggtgggccttaaggtgtgtgaagggaggtcacaagagataaagatgaatcacaggacctcagatgacaggccttgataattgcaggccatggagataccatgtaggctctgagctggtgagtaacatgatcgtagtcgtgtgctaaagaaggtgatgttctttactttccagctaccaccgtctgtatctcccattttcttcacagcccagctcctgaaagacttgattgaacattctgtctttattttctcaactcacattcagtcttcaaacctcacacctaccactcctcctcgttgcctaactactaatcagtttcttggttggctttggccttgtcaagcttgcccttgcttctctggcctctccttcatagcctcctctgtctgcccctcatccccttaaatgttgcctgggctttcagcccttagtcctggaccagcttctctcccaacaagctctcccgaacagcactgctcccgcctgttctgccagtgtccctgccatcctgccagtttcctatggcgtcaaaagatttagggcccacattttacacaacagctttctgttgagcctttgttgtgctaaaccagctctgctctcatctcacttcccaccttcattttccctttgtcttgttttattgtccgtttctgaagctaactgcagcttgctttctaaaccttccatactttctggaacaagggaggcactaataacacatgtgtactgatgactcctaaaactatgcctgtggcccaagctctgtctagggctgcattgtccactatcagaccctctaggcacatgtggccaccaaaatatacattcagtaaaattcatttccccagccacacccgccacatttccgtgctcaagagctgcatctgagtagatgtggatccacaccacattgggcagcacaaatctatagattgttttcctactcaacagaaggttctattggatagcactggtctagaacctagagactgtatttccagctgcaataagttttcgtttgagtgtgtcccatatacatctcaaatccagcatttccaaagcagaacttagtattttttccccaaacttcccttctctttcatgagctctgtgttcccatctcctcagacacccaagtgaaaagtctcagtgctactctcagctctttcctttccttcttcttcccaatggttgtcaggtccagtcttcatcagctgtcacattggcatctctgttctctcccttcccttcccgtccctcctctccttcctcagctccagcccccatcgcttctcacctggactgtatctgttatatcccaactgagctccctgctctaggtctcctagagtttgtcccctgtccacgctgggcccacactgacctttctcaaataaatgtgattgttctcctgtcctttaacaagccagtgactcccctgcccactggatccacccgaacctgtcaacaggccttcaaggcctgccgtgaactgaccactacctgcctcttactccttgctttcctccagacaccagtgtgcaaagctccctgacattcacccatcacacggctccacacctccaaagctgtgcttttactttgcccccacgtggacttgtgctccttcctgccagacacctcttcatttctcaaaatgcaggtcaagtcttgctccctccctgtaccttttctggccctgtgcctgggacagaactgaccaccccccactcttcacccatactgagcccagctgttcagttgactaacatagcttcatttgtttacaggcctcctttccccagttagcaccttaaaaggctgggacatagtctttggatcactggtgcctggcgctcagtaaatgtacaagaaaggaacagaaggaggaagaatcctgactaagaaaccatcgtagtagtaggttaagagaacagaagggctaaagtagtatggtgaaggcagacatgcaaaagccagtctctgtggacttacacaatgccaaagaaatgggcagatttgaagttgatgctgaggtttgattctaaggtcttaggagaatggtacacccaataacaggtaaagaaaggacataaggaattggttttaaaagataaaaattattcatttgattttaggtgaggttatggtgtctacagtacgtccagatgattggagatggaattgaaggttgggggtgtaggtaaaaattagagcaatacactcgaccccaaatgagttttcctctctcttgccagaatgtgaagctttgcatagtgccacgtgggaggtgaggagtgaggaaggaaagtaccagacaacctggggctggaacacagcggccacctcttggaataagatcatcctcacatctgttttatgtttacagttaatagttaaagccacagaaatgttgccagataaaataatttagagaaaaataaagttacttgagtcaa

SEQ ID NO: 3281 - DNA, 110281 bp, human
atcgcacgtgcacgccctgcgcgcgtgctgcgtgaggacgcgtgcgcatgcggacgcgcgcgggttcggtgcggcgcggcgggcttggcagtgcgcctgtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggtattatccccagagtgtggcgggcgcccgagggcttcgggttcctgtgggggggcgggcccggcggcccagggcaaaggtcctcgagcgtggggggaaggggcacggcgcagagctgagataaacgccctttccctggcccaggatcgtccggacgtgcatccaagggccgcacccctctctgtgcgagtggcggggttctttcttggggcgacctgggtgagtgggtacacatggggggtggcttagggtgggcggcaggtgtgtttgggatggaggtgcctgagggggtgctgcgggtccagtccccgtcctcgaggagcagccggcatgggggtcgttaggataaaccgagcggggttctggggttgccccggcctccgcgcgcgctctctctgcgttctgggaaacgcgcgcgagcgccgctgcagcccgcggcgaaggtggcccagcttcgcgcctcttggcgtttccagggggcaaaatcggcgtgtcacccattggcagaggcagattcgcccgggcggccaggcgtctgccccggaccgggtgctcctcccgcccggatgcgctccctgtcttgggaacgctgctcaggtggccgggccgcggccctcaatcgaggcagcggggcaaacaaggctctcagccctcgaggctgccgatgctgggagccatggagggctggtccctggctgcccagaagccagcgaggcagcggaggagactgtgaggacatttggcaggattttagataagcaggtctgatgctaacgttctgtaaagtggttgcaggtagtgcgggggtgtaagcagcatggaaaccgatttcatgctgtttttcctgacaacaacttttttatttttagttaataaggcaggctatttttaaaacattttttattgcagtctaatatgcatttaaaaaaccacacaaaactataattcgatgaattatcacatagtgaagatgggagtattttatatacgatgggccaagaaaaggaaagaaatcaagagaaatcttcttaaaacacgctttttcactggggttgagggggcgaggtagtattttctgactgggccttcagttgcatcattcttaggaggaggagatagcttaaatcatttccagtttgtatttttcattatgctattttaaaggcagaattcattaactgtcacaggataacgttataactacctttgaaatgtgtgcttttgtttttatcctttttgcttgaaacactcaagctgcatctgctagggaagaacctggaaactacccaccagaacgaccctccgtggcagaggcgaccttgtataataaaacactgaaaaggagaggttgtttcagtttgcatttttatttggttgagagcttaaataatagtttgtttcgatgttctgttgtactcatgagaggtggggaggggcggtatgattgggttttcagtgtatcttggattttatttgaaggaacttaaggggtttttttttttttttttttaatggaaacaaaattggggaaggggaggaggtacttttgcgggggagattcttaataagttctgtttggaaactattgtagaatcatttaatgcactcttctgatattaagattagcttaaggatatcttccttcatttgaaattggaaatatagaaaaatatgtgtgaaggtttaaaatgtgaaataagcacctatgtgcattaaggttggtatggtaaaattggaatgtttaatttaggtgccaggtgataccaccatttgttgtttgggggagttagcaaggccaggtacttaagtaaagtctccttagaaaaattatgattttgaggttttataattatctgtcctggatactgatcattcttggttacccaggcccttagcatttgggacccattcctaatgagacttaacctgcttttctagagagtcaaccattgttcctaagcttgggctgggtgctgtcaaggctgcaaaatacagaaagacctgagatgtttaggctgtccaacaattttgtgttgcacacttaggggatatgagttggcaagtggttttcctgggagctgtgtaaaagacggaaaggaaataccgctggtggtttcctctagcaacaggttcttccgatattgaaatcctgtgcatgttcccattaccccctagtgatgccttctttctttccttttaattacctctgaatagaaattaccagatctactgtccattttagtgcttgtctgatacacatagtataacaaatgagcaagtgcttgtttcaatctgcttaacaacctttaaccagcagatagaatcaccagatctcaaccatatttcctttctttctttttagatgaagtctcactctgttgtccatgctggagtgcagtggcacaatcttagctcactgcaacttctgcgccaccatgcccaggatcccagcactttgggaggccgaggcaggtggatcacttgaggtcaggagtttgagaccagtctggctaacatggtgaaaccctatctctactaaaaatacgaacattagccgggcctggtggcgcatgcttgtaatcgtagctacttgggaggctgaggcataggatcgcttgaacccaggaagcggaggttgcagtgagctgacctcgcgccactgtactccagcctgggtgacagagcgagactccgtctcgaaagaaaaacaaaatagggtggggcctggagatagagagtaggtggttattggagactgcgaagggtactggggggtgggaaggaggtaggaatggttaatgggtataaaaaaatagaatgaattaataaggcctggtatttgatagcacaacagggtaattatagtcaataataatttaattgttcatttaaaaataactactagtatgactggattgtttgtaacacaaaggataaatgcttgagggggatggctaacctgttttgcatgatatgattatttcatattgcatgcctgtaccaaaacatctcatgtaccccagaaatatatgcacctactacctactatgtagccacaaaaattaaaaattgtaaaataaaaaaaaaagtagagtgggcccgagtagcaaaggcattgggtccccaagaaatcggagttcttcatcctttttcaaagttgtgtttaaaaccattcttgaacgctttaatcctaaaactgttcagatcgctgggcgtggtggctcacgcctgtaatcccagcactttgggaggccgaggcgggcggatcacgaggtcaggagttcaagaccaggccggccaagatggtgaaaccctgtctctactaaaaatacaaaaattagccaggtatggtggcaggcacctgtaatcccagctactcgggaggctgaggcagggaattgcttgaacccgggaggcggaggttgcagtgagcagagattgagccactgcactccaccccgggcgacagagtgagactccgatcttaaaaaaaaaagtgttcagatcaagaagaacaagagaacaagttgagtttgtgcctctagagtctctttggtagtaggaaggaccacaaacttcctacaaagttgtatttggtttgtggctcctggctttttttactgatggcagcataggacttagacttagcaggaccttcaggacaaactgctgaaagtctttgtgatttctcttctcatatcctagccatggtgacatagctgctcaaagtctgtcatttctaacctgcttcctctccaacatgaaaggatgttttcctctcaggtgccccatcttctgcagtggctagtgttttaaaagaacactttgtcttcttgtaattacattgattgccttacaaaacagaaggattcacaaggttgatttgggcaggcgagagatggagatttctgggggctgttggtaaatatcctggtgggtcttgttgagaggatttgatgagatatattggctggtgatacaatgatactgcctggttttagggggctgttcatgtgctaagttggctcaggcggcagttccaagatttgaaaacttcccatggccctgccctccggtcccttttgaaaggaatttcaccagaagaaggaagagggggtagtagagggcagccgcccttagggagggagtgtccactgtccacctcacatctgagtcggccgcatttaaatatggagtttaccgtcttggcatctgaggctctgggtctgactaggccttgggatcccgcctcgtctgcctctgaggtcagtctgaatgcaagcccccatctgcttttctgttgggaagcatttgttttcctcttgcctaggaactttttctgtttttaaaagccttgtgactagcagagtttgggttgtcatttaagcgaaaggaaaacaggtatgagtgagccgcatgcatgcaaagcatttgaggcaacagcagtgatgccaaatgcctgagatccttggaatgacagggtctgtccccagggctcctagcttctgaccagtgctgggttcgttcaccacctaaaaagacttggcttttcctctcagtgccaaataggttggtgccttgtagcccccaggcaaccctttggaatgttccttgctcctttgtcatctcacccgcttcatccgtcccaccctctgtgtttctgtaataacagctttatggctggtcgtggtggttcacacctgtaatcctagcacttcaggaggctgaggcccacagatcgcttgcactcaggagttcaagaccagcctgggcaacatggcaaaaccctgtctccacaaaaaatacgaaaaattagctgggcgtgatggcacgtacctgtagtcccagctactttaggggctgaggcgggaagattgcttaagcccatgaggtcgaggctgcagtgaactgagattgtgccactgcactccagcctgggtgacaaagtgagagcctgactcaaaaataaaaataaacagctttatcatctgtataaaattcatatgccatatagtccacccatttaaaatgcacaattcgatggtttttagtatattcacagagttgtgcagccatcaccacaatcaattttagaacatgttcaccaccccacaaagaatccccatactcactgacattcttcattcccccggcctcacaactacccatctgtctatatagagaccacgagacttctgccgggacagtcttcagcctttggtgcagacacgcgttgcaattgcctagaagtctgtgggtgggtcttcatgcattagaggtttagaaaccaatattctgcatactctgtccttcaggtctaagacgcgcttttaccctgaagccttgccttttcacctcctgtacattcccactccacagggcctgcaaagcgctcagaacctgaatgtaatgtacacagcggtctgcagttatatactgcacatgttcattttagcttcccagacagtaatggccgctaattgttgagcacttatgtgccaaccctcatagttctgggggttgcctgggcttattggagaagttctgctgctccatttggggtcacctggagtccctcatgctggtacagtctgctggtctgctgggagctcagttgggctcgaaatgtccaagatggtctctcattgtccaggtacctaatcacagagagtctgtcctggactttctaacagcgtggctgctgtgctttgaataaggaagcagaagttgccagttctcttaaggcctgcacatagaagtcccagaatgtcatttttgctgtgttcagtggtcaaagcaagtcccaaggccagcctagattcaaggggagaggaaatagactccacctgttgatgtgagggcagcatgcacctactgggaaatgagaaattgttagtggcccttttggagaatatctactgtaataggcaagtacagtcgttccttggtatccatgggggatttgttccagcacctctcaagaacaccaaaaatcaaggatgcccaagtccctgatataaaatggtatagtatttgcgtgtaacctatgcacatcctcccttatactttttttttttttttttttttgagacagagtctcactttgtcacccaggctggagtacagtggcacgatctcagctcactgcagccttgacctcccaggttcaagcaatcctcccacctcaacccctccaaggagctgggactataggcatatacctctatgtctggctcatttttgtttttgttttggtttttttgagacagagtcttgctctgtcacccaggctggagtgcagtggtgcgatctctgctctctgcaacctcgcttcctgggttcaagtgattctcctgcctcatcctcccaagtagctgggactacaggcatgcactagcacgctcggctaattttttgtatttttagtagagatcgggtttcaccacgttggccaggctggtcttgaactcctgacctcaagtgatctgcccacctcagcctcccaaagtgctgggattacaggcgtgaaccaccgtgcccctccctcccttacactttaaatcatctctgggttactgataataaatgtaaatgctatgcaaatagttgctatactgtgtcgttgttttgggaataatgaccaaaaaaaaaaaaaaagtctgtgcaaccatccactttattttatctgaatatctgaatcttttctttttttttaagatggagtctcaccctcttgcccaggctggagtgcagtggtgcaatctcggctcactgcaaccactgcctcctgggttcaagtgattctcctgccttagcctcccaagtagctgagattacaggcctctgccaccacaaccggctaatttttgtatttttagtagagtcggggtttcaccatgttggccaggctggtctcgaactcctgacctcaggtgatccgcctcccaaagtgctgggattacaggcatgagccaccacgcccagccttaatctgaatatttttagtctgtggttggttgaatccttggatatgcaacccttgaatacagtgggctgattatatgttttaattaagaaaggttatgtattcagcgagaggtgagagattaaaaaaagaagaaaggttaagttatttgcccaagggcacacagtaagtggcaaaccaggcttcacacccaagtgtgtttgacttcggagctgagaaacttttttttttttttttttttttttgagacggagtcttgctctgttgcccaggctggagtgcagtggcatgatcttggctcactgcaacctccgcctcctgggttcaagcgattctcctgcctcagcctcccgagtagctgggactacaggcgtgcaccaccatgcccggctaatttttgtacttttagtaaagatggggttttaccatgttgtccgggctggtctcgaactcctgaccttatgatccacctgccttggcctcccaaagtgctgggattataggcgtgagccaccatgactgacccagagctgagaatttttaaccccccgtgccactgtgcctccacggatggataataaactcctttcgcgcatgagctgtgtctcccacatctgctatacccctctgaggatctagctcagtactatctagccacatcttacaaagatcttgtatgccttttacttagtacacagttgtttttctccccaaaggcgatggggatctcatttcttagaattacagcaaaaatgttattaaaatgcttagaggaagataagttccatttaatggaatttcctagtttaccaggaatgaaccccccatcctctctgtgcccacaattattgttaaggatctgaagatacccttaatcggcttcctgccttaggacactgtgttgggtatgattgaggttcttgctgttaactgtggtcattgctctagaaggaccctggaagattctctgatactctaggctagtgtgtctcaaactaactctggtaaaggagcagtttttagtttttttgtttttttttttttgtaaatttccaatctgctgttgaccagtatcttggtaaaacacagtaaagaaaaatatatgaaagacatggaaaatacaagtcccaatttttaaatatcaggttagattaatattagatttaaagagctcattaagtaacagaatactctgtccagttgctgtaaatgttctaaatgcatgccctcggtggggtgcagtggctcacacctgtaatcccagcactttgggaggctaaggcaggcagatgacttgaggtcaggagttcaagaccagcctgggcaatatggcgaaaccccgcctctactaaaaatacaaaaattagccagatgtggtggcgcatacctgtagtcccagttactcgggaagcggcggcacgagaatcgcttgaaccagggaggtggaggttgcagtgagctgaaatggcgccactgcactccagcctaggtgacagagtgagactctgtctcaaaaaaaaaaaaataaaataaaaaagaagcatgctctcaatttatgcctttattctttattgcagattgataatgaataataaagagattgtgctccctccccacagcccatcagggttaggctgctcagggtttcctgaagaaaaaaacaaacaaacaaaaaaaacgtaaaaaagagagactggcacctgtccacaggacacactttgaatagctctgccctgggccagtatttcccaaagggtatggtacataagagggttttagattgcatgtggacagacttatctttttaactttagattaatagttctgttgattcttcaatttattttaaaactacaactagtacatcatgctacagtttctgaatattttcagaatgagtaaaaagtgaaaaaactacaaaaactaagcgaaaataagtcaatttaaagaaaaagactatccactgggcctggcgtctaggaaaaaaattttaaaaataaaaagaccaaataatagaagtcagtgctggctaatacaaacagaatgctagccacatatgtaatcttaatttttctagtagacacattaagaaaaagaaacggtgaaattaatataatacaacttacttagtcaagtatgttccaaaatattatctttcagcatgtaattaattaattaattttggggggggcgggaaacagagtctctctctatcccccaggctggagtgcggtggcgtgatcttggctcactgcaacctctacctccccggttcaaacggttcttatgccttagcctcccaagtagctgggattataggcacatgccaccacgcctagctaatttttgtatttttagtagagacagggtttcaccatgttgtctaggctggtcttgaactcctgacctcaagtgatctgcctgccttggcctcccaaagtgctgggattacaggtttgagccaccgcgcccagccccttcatcctcttatgtaccaagttctctcccttaaccacactttccttccctaaagtaggtaaaatttggcaaaacaaccaaccaatcctggcttcccctgtgtgaaaccaggtccctcacaatcctctccaaggatgagcattccttctgtctctgctgaaagaaccagacagcacattagatttcatcattttccccaccgccctctgctgtgggctaccccgagcctaccgcccttgccgtcattactaaacctccaaagttcatcagctctgtgtgtagtcctttttttttttttctttgtagaggcagggtttcgcgctgttgcccaggttggagtgcagtgctgccatcacagctcactgcagccccaacctctcaggctcaagcgatcctcccacctcagctcccaagtagccaggaccacaggtgagtgccaccatgcctggatcatttttgaattttttttttaaatagagacaggtctcatgctgggattacaggcatgagccacctcacctagcctcagcatgtaattaatattaaacgttattaatgagatatctgacattcttttctttgcagcaagtctttgaaattccatgtctattttacacttctagtgtgtctccatttggactgtttgcgtttcacgtgctcaatagccaactgcggctagtggctactgtattgtacggcactgacctagagcatttccatcacgcagggagttttgtggtctacattgagtctcatggtgactaagtattcagtgtgatgactgtgctgtcaagtatggcgtgaagcacagtatgtgtgctgtggtagtgagtccagcttggatctcttcttcatgaatgtagaggaaatggaaacacactttgatggaatgggctcccccatatcaggcaaagcaggcccggattccccaggcttttgaagggatatcctgattttgctttccccagcctgggtgaagggagtgcaccaaggctgtgactagtgggtcctcacacagattattgtcttggggacctgatagactgtggaaaggggatggacttggctttgtgggaattattaagctgtcatcgaggaaaagtgctaaggtttgaatgtccattccaaaactcatgtcaaaattgccattgtgatggcattaagagatgggacctttaagaagtgagtaggccatggggctctgccctcatgagtggattattgttgatagtggattcggtttggcccccatttgctctctctgtatcatgggcttgcttgcccttttgccatgttttgatgcaagaagaaggccctcaccagatgccaagcagatgctgacaccaccagcatccagaattgtgagccaagtaaatttgtttgttataagttacccagtctgtggtattctgttatagccactgaaaacagactaagacagaaagcatggtattgaaaaaacatggaaccataactgtgggaggagagagctgtattagccagcttaggatctcctgggtttggtgttggggtcggggtcaggaatccctgctgctgggtagggtctgctgagtcgggattcaatgggctctgtgagattcgatctggtcatcttccccagctggtgtcatgtcttcctagtgccttgtccacagaagccacttgctgattctgaccaataggtactgattgactgttaggacagatgccctaactctgggaactacaccattaaacagggaagttccagtgtatctgggctggttctgcctccatctttctaggtttgatgtgaaagagctgccattagttacagatggccttagtggactgattacccagcacctgcttcagggcctgcaggatgaaccccttcccagaccagcttgtctccttcctgagcagttggtctgtcttcaccgttggtcactgattccttcagagttgactcttggtttagcaactcaaccagtgtggtactctggttgctgtggtagatgtatgggattaacgtccttttcagctccattttttatccctacccttgtttttctctttctctcctactttctgtatttatttctactgtattttatataagcaatcttaatcttttctggaaggagggagggagggcaggaaatgacctcgcagctggagtctcaccaggcacctgcagccctttattaagcagtgctctatgtccctgtttcagaacaacaccttaatatgtgctattaacttgaagtaaccgtctgaatcgtaaactgggcaaaaccgaattctgctgatgtgcttattcttaaaaacagccccccatgggattcctgtatgttctcttccttcaatacctagcgcgttttcagcactacatttaccagagggaaagtgtattgttcatggggatagcatcacctcttagcaggtgttgctcttttctaccctattaattgtatttgtttagttttcttgatcaccagtcaggggtgacagtgggtggtgaaatactgtgacagccttcagtggaagctttccttgtacctgggtaatttttcccctggtggagatacgtgttatgaataaaatttagcattgatcattttcattagctagataatcaatatttttaagcagttgtagttatgtctacagaccaaaagctcttttaaaaaaatcactaattctaggccaggcgtggtggctcatgcctgtaatcccagcactttgggaggccgagaggggtggatcacctgaggtcaggagttcgagaccagcctggccaacatggcgaaaccccctctctactaaaaatacaaaaattagccgggtgtggtggcgcacgcctgtaaccccatctactcgggaggctgaggcaggagaattgcttgaacctgggaggcagaggttgcagtgagctgagattgtgccactgtactccagcctgggctacatagcgagactctgtctcaaaaacatcataaactaaacattaaaaattatgcattttaattgccattttcttactgcaaaacatgttcctgctctccctttttcctctcctcacccacctaaatttccacttcacttgattttacttttgccagtcacaaatttttttctgaagaataattgcttcttattaatagtccattgagctccacatatccctaatcttctgggatgagattaaccctttttatagaagaacaattaagtgaggaaaatggactgtttcactataccctgttcaactttaatttctcttagttgtgttttagtttctctgtttcaaccaagaggcccaagggttctcagtgcctttctactggggagtgttgaatgtcctttgtggtacatagttttatctttactgcttaaaaatcaaaaggattatttacactttggcatgtaaagattatatcagagcaaatggctcttaattcaagcagagataagacatgcaaggtacaacactgtccagtagaactttctgtgatgttggaaatgttctaggtctgaactgttccatatgatggccactagccacatgtggctgttgagcattgaagacctgagtttttaattgtttctaaatttaaaaaaattgaatttatatcagcacatatagtagtagcttctgtattggactgtacaattaactagctgttgactaacctcgacagattaggatcaggaatgaggaaggagtttcagatctcaaacaaagttacttcaaacccacctactcttggtttctcctgtacaggctttgatatttggcacttgtcattcaaccactctcagatgctggtaggccaccaagaacagaaccagcagttagctccttgacactgtatcaggtctgtaggacagtgatcgaactggtagacaagacttgttcctggctccgtggtggccctggagtgcccacagtcagccaatcctctctgtcctgtctcagcttttcaacttggcacaactgaagagtaaaaactggagccagggtctttagtttcacaacttggttggagaaaccagattgacttacaagccattaccaaaccattagataaaaccagtagctagctatgcaggatttgggtgagctgtgggcagagcttttccagcaaaaggttggcagggacctcaaccacaccctaggccagagaaccccgtggcaggaagtgaggttggtgggggcattggatgcctttgctgagttaatcgtgttccctgttctctagcaagtactcagtaaaatggataagtctcagctctttcattctagcttgctccttacaaactgcggcctcagacattggcccctagaactcagttgcttgtctgtacaatgagattgtacacaaggtgatcttactggtgcgttccaactctgtgatgctgtgatcctccacagctggcctaggaagcagagggaagcatatggctgctatctacccttctcattagtgggatcaccagccacatagcttagaacgactcccccccaccccgcccattacagccaaacccgagggttctgccttctttatctctcatgaccgcatccccatggccagtgctttgggtcagactctgtcatctagagcctcaccagtatcagaagaaccttagggatctctgtccgtccgtccaggtcaccgtccctgtcatggatccttcatgtcattctcttgctttaatctcctctgacacttgcctagcacttcttaaagagtatattctaaactgctgttggagttttcaggcatgttggaatggggctccaatttacccctccacccccatctctctggcctgtaaccactcccgctcagaatgttcagcacactttgcacgtgactgcttgtgtacatgctgttctcttcacctggaattcttttcctctctgtgtctgccatcttcattcctgtctaccctgttcatctttcagtacttggctcacacctcacctcctctctgaagccttccccaaccacacacacttttgatggttttttcccttcttattcattttccattacagcattgattatgaaaatgcagataaaccatgtgcaaataaaactgggactggcacttggaaactaaagtacacaaatcttaagtgcacagtctgattatgtatacaaccatgtaacccacacccagatcaagatgttaaatactttcagtacccagaaggctccttcatgcctcctcctagtcaatacttctctcaaaggtaaccactgttctcacctcttttcactatagatttgctttgcttatttttaaattgtattaaaatagattcatttaggagatacttttttattgtgataaaatatatgtaacataaaatttactgttttagcaattttgaagtgtacagttcagtggcattaagtacattcatgttgttgtgcagccaccaccacaatccatctccagaactttttcatcaagtatatccttctttgtgtctctttttgttttcttttcacttgacattatgtctgcaagattcacctatgttgtcacaggtaccagtggttcatttctttttatttctgagtagtagtactttgtgtgactgtatcacaatttgttttatcaattctcttgctggatggacattgtttttttccagctttttattcttttgactaaaacttttatgagcgttatgcttgtgcagataccttgatgcccatacatttctgttgggtacatacctagaagtggaatgggatctgaaatgtcacttcatagattctatataaagagtgtttgtaacctcctgaatcaaaacacaagttccattctgcgagataaaatgatacatcacaaagcattttcacagttagcttgtttctagtttttatcgcttgatattcgattttttcttataggcctcaatgggctcagaaatgtcacctcgtagattctacaaaaagagtgtttccaacatggtaaatcaaaacacaggttccattctgtgataggataggcatgtcttcagcattagcggatattgccaaaccattttccaaagtggcttgtattcatttcttattgctgctataacagattatcacaaactttagtggcttaaagcaaaataaatgtattatctcaattccagacgtcagaagtcttaaaatcaaggtgtcagcagagcctttcaggatgtgctaagggagaatctgtttccttgtcctttccaacttctttttttgtttgtttgtttttttttttttttgagacggagttttactcttgttgcccaggctggagtgcagtggtgcgatctcggctcaccgcaacctccgcctcccgggatcaagcgattctcctgcctcagcctcctgagtggttggaattacaggcattcaccaccacacccagctaattttatatttttagtagagacagggtttctccatgttggtcaggctggtctcgaactcccgacctcaggtgatctgcctgtctcagcctcccaaagtgctgggattacagacttgagccaccacgcccggttgtcttttccagcttctagaggctgcctgcattccttggctcatggccccttcctccgtcttcaaggccagcatcatagcatcttccaatctctttctctcttgctccttcccctccctcccccccagctctacttccactgttacatctcttctctctaactcacctacctctgttgtgattaccttgggcctacttggaaaatcctggataatctccccatctcaagagccttaacttgatcacatctagaaaggtctttttgttatatgggatagcatattcacaggttctgggagctagaacatcgacagcttggggccaatattttgccagccacatggctgtaccattttgtattcccaccacagtgcatgagagttctagttcctctccatctttgtcagtacttggtatggtcagtcttttgaattgtagctatactggtggagatgtaggggcaagtccaaggctgccaccccaggcagtgcatcctcctttgctccagtgatagctttattgcaacttataagcattatattatgaatatgtatttacattcctctgtcttagccaaactaagcaccacttcatgagcaggctatatagtagttgatttaataaaaggtccttggatgcgaagaactgactgagggcagttttcagcagagcagggaagcagagctgaagatataaatgaaagcccatgcttccagtctcaactctgctcagcccccaggatctgagggaagtaggatttccctcaaataaaaataggagtagagcaaagaacctggcttccaccttctgcacactgttgtctttcccaagatagttaatctataagtgagtaatgccctagaaggaaatttgggccttgactcctatgggtgttggttggaaatgacttcactgtatatgtaaatgagaggaaaatacagttccagctggctactggggagtctgatcttggaccctttgcagggactcaggttttccttttccttggactctgctcatgtagcaacatactgcagcttcttacttacagaaggaaagactccaaggtaagtaatgctttcttgatctcagggaatgtctgtcatgtgtgtagacttaaacccaccttggaaacttgaggttggaatgtctgcagaaagtgaagccagagtagagatgaatttccaatgcccctggacacaggatggtgggcacagatgtcttcgtactagaaaagaatctcggaaggtgggattagtattagataaaaggcagacaggatgatggcttctttcgggagcatcctgatgcaaataagcactttctgggttctgtttcattccctagtttactttgctgggcacacacctggtttcatgagggctgtaaggtttctaggcttcattcttacctttctaggctgccgaggtgttagcagcattcctgcagcttggcattgctgtgacctgagagagagagagagagagagagagagagagagagagtataaacttgcagtgtggcagaggacttccttggccctcacaaggtcaaccaaaacctggctggttggtatttggatcaaaagggagtcggtctttgaagaaaagcattatctcaggataggaggtactgtgacaggcctgtgccagagttattggtccctgtttaaaaatgtactgacagtgtcacagctttagtaatttaataagtacatgtgtggttcacaggctgatctgaaacaagctggctgtgccagagtgggtcacacctggaccttgagtagtgtggatggcacacacaccatgagggttgggacagcctgaaccaaactgtggccgtgtgtttatggagtgctgctgacttcttagacatccacttatctctgcctgctgtgtttgagatgtggaaaatgtcaggtggcagcattcatgctgagaactgtccccctgggatttggactccctctttactcgctgccatccaggtctggaggtgatctcgagaaagaatatggggtgagctgtcctctgtaatcagatgggtgttcactttttccaggacaggcactggatctccgctcaacattctctggggctggaggggtacccttcacctcctgggtcaggaagctctttatgttgatagaaacatgtctcctcttgctacccgctcccccccccaccgtgtagagagcggacaaccccttggcatccttttcacagaacttctaagtctccataaatgtggggaccaagagcctttctgtggcctacaccacttccagttgtttaaaccctcctggtgtaactttttatttggagtttactcctgtgacattggtgtctctcttctctaactgtttgcacaaattgtccatagtgagccctttcatctcagttaagaatttcccacttaatctgatcacctactggcttggccactaactagctataggacctggccacaggttagtttcttggcctcttctttacctgtgaaatgggaacatatctgaaatacttcatggggttgacaggaggattgtgaagtgttgcatggaaagtgtttgtagtgcagtgtcttgcacagaggtagtactctgttaagtaggaggggagcttatcatccgtgtagccagtacgaggacctaggctggatgtctgtggacataaaaaagattttttgttatagtgtacacttatatcaatatagtcatattgatatatttatgtatggtctttgccttccagggaactagtaacctagtgagataggttgtctctaacttactgtaatccaagttgagcattgataagtaccataaatgaaaatagaaaaatggaccataaggctatagatgaacagttcattctggctgagagctggggtcagtttttgtgcatttatgagtcccaaaggcaagtgatttttttgggagggacagtcacttatactttggtggcccatggttagcaggacagcacttcccacctggaagtggcctctatctttggccacgttcttcagtttctgcatagaaatgacatttctttttctcccacctagtgcttaatttatgattgaaattcttgaagtatccagtgatgccctattcaggaggctgtccagccagtagcattcctttttattcgttgcctaatgcaacactgacagtagcgttcatttttctcttcctataagtatgtcaaagtctcttatcctaggtcctagttctcactgtcctaggtgagctttctcttcccactttgtgcagttagtatttttccacagacatagaagaagaaaagagcactcttgttttttggccccacccctctttggcacacactacttaggtgcttcaccccacacattggcccagagcttaagagaaggtcatctgactgtctggagctgtggaaactgcacatggcttttggcaagagaatcttgtggtgtgctataagtttttaagtttaagagtttacactctgcactggataatatggtaactaattccatgtgtggctacttaattaaaattaaataaaagtaacaattcagtttcttgattgcactaagccacatttcaagtgctccatagcccagttggatggcacagatatagaacacttctgtcattgcaaaaaattccatgggacagtgccggtctagggggttgccttatagttgtaggctactaataggaaagatagatgttcattcaggcttcagtggtttagattttcctcctgaatgacccaagttgaatgtctaagctttaaatctcatcaactaatgcaattaaaatattttaaccttcttaaatttgaatacaaaaagggtattcattttctgaagtcttttttgtgctgccgaattaccctgaagtagatagcaagtgtggattcttacaggtgaggaccttaatttgttttttattgtggtagaatatacataacataaaattcaccactttaaccattttaagtgtacaatttagtggcattaaatacattcacaatgttgtgtaaccattatcactatctgttttcagaactttctccatcatcccaaatacaacatatacccactaaataataacttccctttccacctccccccagtctactttctgtctccctgcatttgcctattctaggtacctcatataagtggaatcataaaaaatttatccaatgtactgactcatttcacttagcataatatcctcaaggttcattcgtgttgtatgtataagtagtatgtgtcagaatttcttttttttctttttttttttttttttttgagacaaggtcttgctctgtctcggagactggagtgcagtgatgtgatcatagttcactgcaacctcgaactcctgagctcaagtgatcctcccacctcagcctccccagtagctaggactattggcgtgcaccactgtgcctggctaattaaaaaaaaaaaaaaaaaaaggacagggtctccctatgttgcccaggctgatcttaactcctgaccttaagcaatcctcttgtcttagcctcccaaattgttgggattacaggtatgagccactgcacccagccagaatttcttttcttttcttttctttttttcttttttcctttttttttttttttttttttttttgaggaagagtcttgctctgttgcccaggctggagtgcagtggcacaatcttggcttacagcaacctccgtctcccggtatcaagtgattctcctgcctcggcctcccaagtagctgggattacaggtgcccaccaccatgcctggctaatttttttgtatttttagtagagatggggctttgccatgttggtcaggctggtcttggactcctgacctcaggtgatccacctgcctcagcctcccaaagtgctgagattacaggcgtgagcctctgcacccagacttcttttctttttaaggccaaataatatttctttgcatagatataccacattttgtttatccattcttttgttagtagacattggggttgcttcccccttttggctattgtgaataatgctgctgtgaacataggtgtgcatacatctatttgagtccctgcttcaattcttttggatatatacccaaaagtggaattactggatcatatagaaatgctatgtttgaccctgttttgtgccaggggagaagtggggagacagggtgggtcttgctctgttccccaggctgaagtgaactggtgcagtcgtagctcactgtagcctcacattcctgggcttaagttatcctcccacctcagcctccaaagtagctggaaaaacagtcacttgtcaccatactcagctaatttttaaattttttgtagagatgtggtctcactatgttgccaaggttggtctcgaattcctggcctcaaatgatcttcctgcctccacctcccaaagtgccgtgattacagacatgagccactgtgtgtggccttggccctgattgaaaaacaaacaaacaaacaaacaaacaaacaaaaccttaaaatcattgttgagatataactcacaataacataaatttcattcttgtaaagtgtacatacagcccagtcgttttaaatatattcacgaggtcatgcgatcatctccactagtcactgattttttttttttttagacagagtctcactctgttgcccaggctggaatgcagtggtatgatcttggctcactgcactgcctgggaaaacaggcgtgagctactgtgcccggcctagtcactgatttttatagcctcttaggactaaagggagagggagaatctagaaagtggcttgggtgcaaggaagggagctttcaggattatgtataatactcttaaaacaggatatttgttaatcctagcactttgcgaggccgaggcaagcagatcagttgaggtcaggagtttgagaccagcctggccaacatggtgaaatcccatctctactaaagatagaaaaattagctgggtgtggtggcacatgcctgtaatctcagctacttgggaggttgaggcaggagaattgcttgaacccaggaggcagaggttgcagtgagccaagatcgtgccactgcactccatcctgggcgacagagcaagactgtcaaaaaatatatatatatatacatatatatgtatatatatatatatatatatatatacatatatatatatatatatatatatacatatatatatatatatatatatatatatgtatgtattttttttattaccaattccttgaaacgtctcataatctttagcaacaatcctctgcccactgcgaggctttctgacctgaagtttagaaaggctcccctgctacctgacatattttcagctactcgtgaggccttgttttatggaacgggatgttgaagaacctcacaaatgggtcagactccccagcaatgctctggaagcctgcttctataggagcagacaggtgttcatgtgctataagctttgtcacatgcccttccctagcagggaactacttctgttccttctctggttctggtcctaaattctgaagctacttgcatttccaaacataaagcaagttgtttataataaatgccttaaatatttgattttcagattcatattgctctgctttggaacaaggaatacaactcctctgcttttgttattacaagccatttatacatataccagggtgctctggttttcacttgttctcatcctttagttgtggttttaatattttgtgctttggacatggttttattgtggttttcagatacatggccagttttcttttctttctttttttaatacgtcatacaattcacccctttaaagcgttcagttcagtggatttagcatattaagtcatgcaaccatcaccacaatcaattccagaatattttcatcaccacaaaaagaaatcccttacttgttttaccccaaccccctgccctaggccacccaactactaatctcagtctctatagatttttgaccagcgttcttgcattcttgtttaatggttattttttatttttatttttatttttttttgagatggagtctcactctgtcacccaggctggagtgcagtggcgcgatcatggctcgctacaacctctgcctcccgggttcaagcgattctcctgcctcagcctcctgagtagctccgactacaggtgcgtgccaccacgccaaactaatttttgtatttttagtagagacggggtttcaccatgttgaccaggcttgtcttggactcctgacctcaggtagtccttctgcctcagcctcccaaagtgctgggattacaggcgtgagccaccgcgcccaggctaatggtgactttcttcctctctaaattataatataagccaccacccttttttccgtctctgttccatttttgtcttttccccttccctccctcccctcttctgatattagcaggttagctctaaattctccttaattagctcccaaaccggatgaattggtggatgtggcacaactgcaggaattcatccaacaaaccagggatggacaaatagtgtgtttgagccctcgaacacccttccaagtcatctgccttcattctgtcactatgaggccagccttcttttcactggctgggaggctgtgggaactgcgagctaggccagcaagagagaactgggtggaagctggtctcagattgatcagtcacacagcctggggagcaatgaactgagatttcagtgtgtggcccatgtgagtgagtactgggacagaaatcaaatgcttgccttacaaatgtagtgtccagatgtataaattcagccactggatcctcctatcaacagaaacatttaatagtcaaattacagtttcaaaatcagtttacaaattacagtctgaaaatatcagtatttaacttgagaagcactgttactcgtacctggtacagagtcagaactcagtgaaacttcccctttgccctctgaagttttgctgaaaagtgaactcacaaaagacagattaattagagaaaaggcatacacattttattcacgtttatacagggagaaccatgagtgactacctacctccaacagggttcagaggctttatataccatcctggcaaaataagttataagacgggggaagaagaggaattctgttgagaggatcactagggagaataagtggacaagataacttgtatactatcttgtgaacgggtctttcaggtgtggttacattcctggtcttacaaggaggggaagaaaaaaataaatgttccttttggtgggtctggactttaggcacataaaggaacttcaacttcgtcctgctttgggagagacattggtagggggaggagggggaaggtcagagagaccttgaggcttcttcagttcagtacgtcaaagtgccatattttgggatatctgcttctgagccccaacactgttattaagaggccatattttattgtaagcctactgtatacaaggcacaggttaggttttgtgaaaaataagccaaagcttcttgaatggaattcaagccctatttatgttataatgtgcaggagtttagcaggttaacactggggaagcagagacttggtagcatccacattttgcttgtttctttagaaccatatattttattaaataaatttttataaaacaatgtgttaactgtagataccctcaacacaggaaaggtttggttaagcttagattcttgctgggaattgtagatattataatttcttgtggataatttaaaaaatttatcatttactattggccactggtagctttattcaaggcaaaccatcttgctcaaaacaaataaccttgaccaaaaaggtagccaggatcctatttagtctatctacagattgtttttggttaaaaagacatcagtgtttgttccatgccatatatgtatctcctgtttcattacatctccgtattgctgggaatgaaacgagtaccagcaggcccttgctgtggaattttctgagcgaggtcagagagaagcacagtgtacttttagaacaagatctgtcctgcctttttttgtattctggagtacacttggggagaaatagagtaagctgctgtttggggaagaagtttgggcttttgatttattttgaaggagtttaagaaatgctaccaccatgcctggctaatttttgtatttttagttgagaagagatttcaccatgttggccaggctggtcttgaacttatgacctcaggtgatccacccatctcggcctcccaaagtgctgggattacaggcgtgagccaccacacccagccaatactagttttttttattgctaaagagtgttctgggccgggcacggtggctcactcctacaatcccagcactttgggaggcagagacaggtggatcacctgaagtcaggagtttgagaccagcctggccaacatggtgaaaccccatctctagtaaaaatacaaaaattagctgggcatggtggtggccgcctgtaatcccagctactctggaggctgaggcaggagaatcgcttgaacctgggaggtggaggttgtagtgagctgagatcgcgccactgcactccagcctgggcaacaagagcaagactccatttccaaaaaaaaaaaaaaaagagtgttccactcacagtgaatataccacagtgtttttgctccattgctgttttatccattctttctttcttttttttttgtctaagatgaggtctcactctgtcacccagactggagtgccgtggctctacctgggctcattgtaatcttcgcctcccaggctcaagcagtcccacctcagccttctgagtagctgggaccatagtcacgtgccaccatgcctggctaagttttatccattctcttgctgatggatagttggactatttccggctttgagcaataatggataaagatgctgtgaacatgcatgtgcaaaccaccttgtggtcctgtgtttgctttatttctcttgggtaaatccctcagggcgggattgctgggtcatatgtatgttttaactgtggaaagaactgccaaatcttttcccaagtggttgtattcttttacaccctcacctgaagtgtatgaaagttctaactgctttgcacctttgccagtacttgctatagtcaatttttttgtgggatttaaattttttttgccattccagtatgtgtataatggtatgggtttctcattggttttaccttgcatttccctgatgattaaagatgttcaatattttttcatgtgttgattaccatgtgaagtgtttgttcacatttttttttttttttttttttttgagacagagtctcactctgtcgcccaggctggagtgcagacagggtttcgctatgttggccaggctggtctcgaactcctgacctcgtgatttgcttgccttggcctcccaaaagttctggaattacatgcgtgagccaccatgcccggccggattcggcaactaatttgtacatcttaaagctcctacaagtttatgacacattattatatggcagaaatagactaaaaataactttctgtgcaaaaatagttctggaagtcgtgtcacagggctcttggcccagcagggagccacttttaactagagctaaaagccagcattgtaaatagcatagaattgactgtaaagaggcaaaagggaatgttttgggatgatggaagtgttctaaaacttgattatgggggtagctgcaaggctatataaattcacagtggtcacttaaaatgggtgaactttacagtatgtaagttacacctcaagaaaactatagtaggaagaaagggagaagggggaacgagggaggagaggaaaggaaaaggaatagaaaagcaagcacaaatataggagggcattgttttgtaaaaacccatttcagctacagaaatatgtacattgtaaatatgtatttctaattgtggagttattaatgatctaaaacgttggaaagctcctgctccaagggaatgacatctagggcagtgctttgcaaacttgatgggaatcccctggggatcttcttataatgcatttcatattcaataggtctggggcagggactcagagtccacattttgaacaagtttcagctcatgctgacattgctggtctgtggacctcacttctgagtagcaaggactagggcataaattgaggctgagctattgagaatacacaaacttaatactgtcattgttggaagggtctttagaaaaatctagtacaatatttcccaaatggacatcatcatgagaaccttctaggggtacttattaaaaacacagattcctataatcaagacagtgtgatactggcataaggatagacaaacatatcaatagaagagactgcagagtccatatatgagtaattgaatatttgacaaaggtatcaagataatttaatggaaaaagaacagtcttttcagcaaatggtgctggaacaactgaatatccatatgcaaaaaatgacccgtgattgataccttgcatcatatataaaaattaactccaaaatagagctaaacctaaagccataaaacttctagaagaaaatacaggagaggccgagcacggtggctcacacctgtaaccctagcactgggagaccaaggcgggcaaatcacttgaggtcaggagttcgagaccagcctggccaacatggtgaaaccctgtctctactgaaaatacaaaaattagccagaaattgcttgaacccgagaggtggaggttgcagtgagccgagatcgtgccactgcactccagcctgggcaacagagcgagactctgcctcaaaaaaaaagaaagaaaagagaacacaggagaaaaccttcatcaccttgggataggcaaggacttcttagaacacaagaagctcaaattataaaagaaaaaaattgataaatcaaaccatcaaaaattaaatcttcttttcttcaaaagacaccattaaaattaaaaggcaaataagatgaggagaaaatattcacaataaaaatgtcagacaaagaactgtgtccaggctgggtgtggtaactcacacctgtaatcccaacactttgggaggctgaggtgggaggattgcttgagcccgggagtttgagaccagccagggcaagatggtaggaccctgtctctgcaaaaaaaaaaaaaaaaaaaaaaaaaaaaaaaaaaaaactgaaaattagctgggtgtggtggggtacacctgtagtcccagttaccagggaggctgagccagtaggatcccttgagcccaggaatttcaggtgacagtgagctatgatgatgtcatggcacactccagcctgggacacagagcgagactccgtctcaaaaaaaaaaaaaaagaaaactattgaccaaccttcttgtgaataaaatataagcaaataaaaacatcttgcagctcagcaagtaaccccaaaaatgtgcagatgtgaacagaggctgggcacagctcacacctgtaatcccagcactttgggaggccaatgcaggcagatcacttgaggtcagaagttcgaggccagcctggccaacatggtaaaaccctgtctctacaaaaaaatacaaaaaaaaaaaaaaattagccggacgtgatggtatgcacctgtaatcccaactattcaggaggctgaggcaggagaattgcgtgaacctgggaggcagaggttgcagtgacccgagatagcgccattgcactccagtccagtgacagtgtgagactccgtctcaaaaaaaaaaaaaaaaaaaaaaaaaaaaagaaaagaaattagttgctggatccataagttaaaagaattttgaccttcttaaactccccagttgacttgtgacatgtttttaagcctggacctgctatttgcttgtgtgttagaccatgatggttagcagagaggtaaaatgattttaaatattttactaagtaatagtcacatgtgtctgaaatactgtaatttctgaaaataaggctagatttgtgaagttttattgccaagacaggctctgaaaatctttccttaaatgaattagaagcccagagttgaatatgttgttttagtctgtttgtgttgctataaaataatgcccgaggctgggtaatttataaagagaagaggtttatttggctcatgattctgcagactgcaagaagcatctgcttctagtgagggcctcaggctacttccactcatggtggaaggggaaggggagttagcatgtgcacagaccacatgcagagatagaggaagagagagggaggaaaggcatgtgctgggctcttttttacatccagctctggagggactctcatgggaactaacagagcaagaactctcattaccacgagcatagcaccaaaccctcatgacccaaactcctcccacctggctttaccaccaatcttggggatgaaatgtcaacgtcagttatccagactatagcatatgtgttacaggtttctgttgtgaagtgaaatatattttcctttgtaaatcatgcctttaagacaaggccttgcctttcacctctaggcaactgtcactccccccaccaatgtgttattctggagtcagactgcctgagtttgcaatgcacctctgccacttaaccagttctgtgacctcaggaaagtgtcttaatgtctcagtttccccacctggaaaatgggtacaataatagtacttactgcatagatttgttaggataatcaaataagtgtagacatgtaaagtatttagggaggctgaggcaggagaattgcttgaacccaggaggcggaggttgcagtgagctgagatagcgccactgcactccagcctgggcaacagagcgagactgtctcagaaaaaaacaaaacaaaacaaaacaaaaaaacagcatttaggactgtgcccgacatgatcaatgttgattattatcatcatcattattattgctatcctcattatcattatttctctaaactggctgttgtcgaaatctcttattaagctattttccatgcctcccaaattctttaacaactaaacttatggcttttcccccaagtctcctgaggctgcttcctatttctgcacatttccgcatacgatgccaaccactgttctcctggcttcctgggccgaaaacttcagatctcctttgactctctcctccccacctccattcagttgcctatatgtgtagtgtctaccttttcatactagaattatcctttcctttccattcagattctaatcacctctcatctggattattcatttatcgtgtagctgaaatgggaccgtgtagctgaaatgggaccgtgtagctgaaatgggaggacagggttcccgtgggcccagccctggacccacctgtgtgggataggggacaggagcagctgggaagacaggattgggtgcgggacatggacatcagcagtgtgagggacaggataaggaaaggacagtgagaaggcggctctgagaaggaccggccacaccttagggcctgcctgtatttgaaatgcctttattagcttttgcatattcctcacagacatctctttgcatacaatgaaggtctttgggtgaattggatgaaatggcttgttaccagcttgaatgatcacttagaaaaaaactgcgcaggcctgcacggtggctcacacctgtaatcccagcactttgggaggctgaggcaggtggatcacttgaggtcaggagttcgagaccagcctggccaacatggtgaaaccccatgtctactaaaaatagaaaaattagctgggcatgttggcggatgcctgtaatcccagctacttgggaggctgaggcaggagaatcacttgaacctgggaggtggaggttgcagtgagccaagattgcaccactgcactccatcctgggcagcagagtgaggctttgtcacaaaaaaagaaaaaagaaaaaaacttgagaaaacattttaccctgttccttctctttatctttgtttcttacatttagtgaccatattggctatgtattgtgtgcatacaaccatcacgccctgtccttagcagagaactccaattttgaaacctcagaaggtggatactgtgctcgatgaaagtactcagtgccatattgatgagcggaatgttgggttaccttgggaacacagacgtccttccttgttactataaaaagggccacagtggctgtggttgtaaggcaacctacattttactgattctttatggtaaaaacgtgcctgtagggaaatgctgtatttttttaagaactttgatcagatacatcagacttccttttagtgctgatcaaatcaggtaaacccagttttcagtacttacgggtttttacaagtatcaaagctgtttccatccatccttcttctcctctttcctgtgcccacagtaagtaggcaggatatttgttgtaagactcaatatgaattgttttcaccaacagggattatgactaagagtataatttatactaatgtccttaggaggggacttatttgcctggtagggcctgtataggtcatatgaaggcagatggcgtgtgtttgacctcctcagggtggcctgttgagcagggttgcctggccaagtaagccttcccactccagattgtgaggcagctcaatgtgtttgcctcgcttgcaggttcctaccatggtttcactgtactgccatctgggaaaggaaggttggtgcagtttattccataataattaaaagccttaccactactaataaggcgtttagatacagccctactggccgggtgtggtagcttacacctgtaatcccagcactttgagaggctgaggcaggtagatagatcacttgaggtcaggagttcgagaccagcctggccaacatgtcaaaaccccatctctattaaaaattcaaaaattagctgggcgtggtggtgcgcacctgtaatcccagctactcgataggctgaggcaggagaattgcttgaaccagggaggcggaggttgcagtgagccgagattgtgccagtgcactccagcctgggcagtagagtgagactctgtctcaaaaagaaagaaagagagagagagagggagggagggagggaacaggaaggaagggagggagggtacagtcctacctaggggaacaaattatgcccattgatgctgtcaaacacctatcagaagtttactaattctctgcgattgaagaattattttattattgctaccatttttaacaaagccacccaaatgggaatcgtgtttattttctttatcgttttctgaggttttatattactaccgtatattgatgtggcatgaaccaaggtgtatacactgtgaagaaggtttttttattcgtcacatgcagtgtagcttactacagcaggcttccttacccttggcactactcacttttggggctggatgattctttttttttttttttttgtgagtcttgctctgttgaccaggcgggggtgcagcgatgcggtctcagctcactggaacctccgcctcccgggttcaagtgattctcctgcctcacactcccgagtagctgggattacaggcgcgtgtcaccacacctggctaatttttgtatttttggtagagacagagtttcaccatgttggccaggctggtctcgtacccctgacctcaagtgatccactcgtctcagcctcccaaagtgttgggattacaggcctgagccaagggctggatgattcttgtttgaggctgagggttgtcctgtgcactgtagaatgtttagcagcatccctgacctgtacccactagatgccagtagcacctccccaggagatattttggagtctcaaaatatctccagactttgccaagcactggggtacacagtctcccctggttgagaaccacagtattagaatgtaaggattgtgtagcttgctatttttaaaggcagtggtcatctgaagcactagttttcggtcagctataatagaaatgtatgtattgacctttaagtatgacagtttggctaacttaaaataatgtggtaaatccaaaacccgattgctgtgatgtgctagcatgcttaaatagcaacagcatattgctgttctttgatgatcgtttttacagatgaatggcaacacacaggatttgaaaatgcatatatcatttatttttatgttcctgaaatgaaaaggaaagaaatagtgacagccacaacagcccaggtaccatccatactcaggcatacctgtagtgcacatgggaaaagcacttttcctatgtgttattttggaatggcagtggccttttctgtggaatggccaaaagagaagcttgtacatgtccataaaccttgggaattctcccctgaaggcctcgttgttttacttttcacaaatctttcccagaaccaaatattcagttccacggtttaccttttcttttgtatcataatctgtagttttactattttcaaaatcaacttttaactactggcagcaataaattgaactttaagattcatggttcttttgttttccaaagagggttttagcagggatgcggttagaggctggaggtgggttagatagaggtaaatttaattgacaagctagagataactgcgaggctgtttaaaaggccaaccagactgccctgaacaatgttgaatgcggttacacattgtactctgcttttgtggtttaaaaataatctatctgtggccgggcgcagtggctcacgcctgtaatcccagcactttgggaggccaaggtgggcagatcacaaggtcaggagttcgagaccagtctggtcaatataatgaaaccccgtctctactaaaaatacaaaacattagccgggtgtggtggtgtgcacctgtaatcccagctacttgggaggctgaggcaggagaatggcatgaacccaggaggcggaggttgcagtgagccgagatcgcgccattgcactgcagccccgacaacagtgcgagactccgtctcaaaaaaaatacaaaaataataatctatttgtgccatgaagctgtttcctcaaggcctcaaagtgcccttgaagattgtccttgtttaagaattatgttgtggctggactgaggatgccagacgcacagatctgtaggcctaggatgggggtaactctgctgggcatgtttttcagagacaaatggaaatggaacaggggttctaactttcaaaatcatttttaacctgtctcccaattgttgtaataccaagagttttactctctaattaaaaaaatattttttgtagagacagggtcttggtatgttgcccaggctggtcttgaactcctggcctcaaacgatgctcccactttcttcctaagcactgggaatacaggcatgagccactgctcccagcccaaaagagtgattttttttcctagcccctttatttatcctttgcattttgttttaaaactaaggaatcttcttgaaacggaagccagctggtggtaggagcaggcctaagcactaccctgatgacttgcattgctcttcagtagccttgtcagtggcctctggactcagtggtgtaactgggaccatctcttctgtgggctggaattgccatgagctaagttggaatagcagggctaggagagcaagcagttcacattgggtagtttgtgctcagcagtgattaaagctcagatctgggccgggcgcggtgggttatgcctgtaatcccagtactttgggagtctgaggcgggctgatcacctaaggtcagaagtttgagaccagcctggccaacatggtgaaacttcgcctctactaaaaatacaaaaagctgagcgtggtggtgcacacctgtaatcccagctactcaggaggctgaagcacaagaatcccttgatcccaggaggcagaggttacagtgagctaggatcgtgccactgcattccagcctaggcgaccgagtgagactctgtctcaaaaaaaaaaaaaaaatcagatctgatgcccagtgagatggccaaggaagagttgtcagcctaggaagaaggggctgtcctcagggaaggggtctgaagggtcctgttaaccctgtaacagtgaggttggagggaccccaaacaaccacatacatgtaattgtgcagaaacagaaacaaggaatgaggacaatataatcagcttgagacaaagagcttgcagttggcttgctcatactcaagagtgcagcttgtcctatggtagggacctggggccttatgggcatctgggccaggagtgccatggagattggctggaaaggtctctggtgagcctttgggatccttttttctttctttttctttttagctatctccctataggaaggatgagactcttttacatcttttactttcatgttattaaacacacatacacatcaccatgaatagaaatcaaatgacattgctaatactggaaactccacaggtaatttctctttaccagtcattacctgctgggttctgtccacagtttaaaagagatatttgtacatttcttgtgctttgttgctgagaaaaagcaacaagcttctaagcaagagtcatttatccccgtgtcttggccctctttccagaagctcaaagcctttctgagtcttgtcttggattggtgagttgggagcttgtattttcacatgacacaaccctcattgagcaaccgcttctcctgatatgtaacctgaaagccagcctctgccccaccattacaggaaaatactggctgggttaggctgaggaataatgatgcctgacatttattgagcagtgcttgtgtagcgcatagtgtactgagcagttccctcttttccctcctcctgtttgcatcctttccctctcaattaatgctcctagtgatccagtgagtgggcgcgatctccatggggttagaacccaggctacctggctctggagcccctgctcccagggcactgtactcagctgccctctctgtacttgctgggggatgtgggggtgctcttcaagggtcattttgtctgcatgattggagccctttatcaggtgagactccagaagctcacgcaaaagccctgcatgtcagagcctctccatctctaaaggacctgaggccaagttcagatgcccagacctacatgccctgtccatggtagaaaactctacccttgctgccctgtccatgtttactgccttatctcattctagccccatttgcttgttggttttttgggatcaccttgtatagggtgggtagaatccacattcttgttgttgaagaacaggcatgcacaaaaaactgtgatgaacagaattacacagaaaggagagcatgaaggtggaggagagatgatcttgcaaccaccgcacagggaagaaggctgggaggacagacctcagcatagagtcacccgtattaccttagggagccctgagcttagctgtataggtttcttttaactagcaaatcatgctgtgaatagaatatgctgtgcatattggcttattttgaaattacatataattgtagaaacacaggaagctaggtaattcctgcctcccagatgaggatccagggtgggagctaagctttcatatcatggtgcccggtagataatcagttgagtttaatttttctagactatgtcttccttcgctacctttgagtttgctcatcttagcttctaagcaaactatcagcttggcagagaaagccttagaatgaaaactgtgacctcttaggaagttgtggggggtttcctggagtagttttatggggttcttgggaagactgaaatgattccaggatttggggcccagtggtcatctgccccaacttgttttgtctgtgttctcttctatcatcaggggaaaggagccaactgtgaatactcctgcatgccaagcattttcaaaaggtcttgcctctaccccataaccttgggatgtaggtagtaatgttcctattttatagaagaggaatttaaacctctgagatgttaaggaatttacccagtctcttgactaggatacagttgggcaggccacatggatggagccaagaagaagctctcagggccgagggggctgagctttatctatgaatggggagaaaatccaattgaggcagttttactgtagctgtagaaagaaccaggcctttggggcatttgtagctgggatctgatgtagactggagacagttaaaagcatgagaaagtcaggttaacagttaccctggaagataacagctgtcaaggaagagttcaggaccaacgaaccagcttcttagatttccttatcttctggtaaccagcaaggttaggcctttttgccatgctctttctcttcagccactgcctgggcctttgcaggtgacttcagttcccatgctggccctggcagaaggcatacctcctatttcccatgctgcccttggagtccaaatacaccccacttcttcacagggccacagtgaagatgtggttacctgggagttgccgggttattcttcatagctttgggcactaacaacatatggcaggtggtcagcactgaattttgccttttctgtttgttgctgtagttgttacagctttgaaaataggtataaattacatacactacaatgcacaaattttaagtctactgtttgatgagttttggcaaatatgtacactctcggggcctagcctacccaatgggtcccccactggaggcttggggcaagctgaagacattgctgatgtgaaaacaaggattaaagatcagggagggtcaggggctggttctagactgtggtagtagacatggtggtggtcaggtaatgagattaaggaatactcatgctttctggatactcaggacatatctcatttcagggccatatctaaaccagtaataatgatgataatactgttagctaatatttattaggcatttaatatgttctaagagctttgcatatattgttccttaagctccacattactctgtaacacaggtgctgtttaacagctgagaaaagtgaggctgagaagcttccccagaagtcacacttagtgtgtgctgagcagggatttaactgagctgggcagagcccactcctctttcttagcatcatccttcgtgcttcccagtaggaatagctaccattttctagatatctaggtctctctgtcagtgctccttccctttaggccctctcattattgagagtcaaccagactggcctcaaattcatgctttgctacttaatagctgtgtgactttggacagatttcttaacctctctgagtctcaatttcctcatctataaaatgggggtgcctcccacctcctaggagtattgtgagcattaaataatatttgtagagaataatgcctggccagaagtaggtgcttaggaactcatatttttagaaaaagacaatctagcccacaaatacgtgtacagtcctcaaaactaggcactgttgaattttataacttggcatgttgtcttttggttctggggagcttatttaccagattgagttactggcgcaggagttcctggggtggctgagtacatgtgtatgaatatagaataacatcatcatataccaccttcataattagtgtttgtgagatgtcatctctacgtactttttaaataagaaattacttattttgctgaagacaggatctctcatttctaccataaagggcgtgtgtctacatgtgtagacaaaaacaagcaaacaaacagtgattggtaactgatatactctttgcagaagatgagaaatgaagaggacatatacatgtttctagtataatttttgttggaaaagaatccttgccctagttttacactggcagtgttgtaatgtactctatcttatcacccccattaggaaaggtagcctgattgaggtttccaggtgtgtgtgcagaggccctccatagtggaaggtggagaacaataaataggagcatgtgcattagaatagccaacgcagaatagctggatttgttgagctcctattgtgtgctggatacagttaagcagtgcctatatctcatttaattctcactctatgataggttctactcttatctccattttatagaagaggaagcttagagcaggtcctgcggaactttcctgttttttttgttgttgtcgttgttgtttttttagacagagtcttattctgatgcccagggtggagtgcaatggtgcaactttggctcacggcaacctccacctcccaggttcaagcaattctcgtgcctcagcctctcgagtagctggtactatgtttatgccaccacacctggctaatttttatatttttagtagagacggggttttgccatgttagccaggctggtctcaaactcctgacctcaggtgatctgcccacctcggcctcccaaagtgctgggattacaggcgtgagtcactgtgcgcggctagaactcctgttgtaccttcttctgataaccgtgtgtagaggattttgtggcagaatggtgatgattacatgccaagttttggagtcgggggtcaggggagggatccattctcattattattatttgaccttgatgtcaaagtactatgcactttgtattgtttgggcttcgcccaattctacatttggtggggaaaatggcccttctcttagctgtgcaattgtgatttaagaaaatcatttaggaatcatttgaattgtttagtaataatcttacatgtctgcatttttctggaaaatgtaattcagttagctgttttaaaaggaaacctatgggaatttagtgggcatattttataaaaatctattaacggcgtagatttgtatatagtcttaaagtagttccctatttctccacttctttcttttcaaggactttttggcatctgtatacaatttttttttttttttgagactaagttttgctcttgttgcccaggctagagtgcagtggcgtgatcttggctcactgcaacctccacctcctgggttcaagagattctcctgcctcagcctcccaagtagctgggattacggtgcacgccaccacgcctaatttttgtatttttagtagagacggggttttgtcatgttggccgggctggtctcgaactcctgacctcaagtgatccacccgcctcagcctcccaaagtgctgggattacaggcatgagccactgcgcccggcctgtatacattttttaattgtctataccttttggatgtctataccttcatcctagtagtcagtagttattgaacttaattcctagttctagacttgcctcattcaaaagtatgaatcatgacatctttgaaaggggcacgttgcaaggaatgaattgggtgataatagtgacttattatcaccatttaagagaaaatttaagccagttcagaaaattatagcaggtaggaaatggattagatcattcattgtcagagcgtggtccctagactagcagcatcagcatcatctgggaatttattagaaatacaaattctcaggccccaccccagacctactaactcagaaattctaggggtagagcccagcaatcagtttttaataagccctctaatggattctgatgcacacgaaagcttgagaatcattggattagaaccctcccccacccaaaaaaatgctcggaagagttattaagctattgcaagaaatggcatcttcctgagagacaaatttaagttgaaaccacctggttctgctcttgtcagagatagaaaatggaataaatggccactgataggtctttgtaaccatatgattcccctgaggttagttcctgcctaggtatttgtttccaaaataagtatcccaaataaataccagaacttcatgtaatagtcgaagaaatagaattcagtagtcaaaagggattaaaagcaatttgtacatttactggagactagaaaagtgtcaaaagatgaattcctaatatgcagctttttgcctcgtcctctggctcccagtattatttgtgcacacacacactgacacacccacacactgtaccttccaagagtcacacaaaacccttccctcactcaattcctagtcagaactctccccagaaacagtccaacatggctcatggcttcctagtccctcatctctctttcacttccttctctcttttattccccccatcccccacccccatgcagcatatttttcccctttccagtgtcgattaatgaaaactgattcatttctcacagtcctggaaatctacccacatacattctccatctgtgtaatgaaagcccaataactgattcatattggatgggtagaatggaaaaagccaagaacataaagacagagttctctttctggtggagagagagatggagcagtctcatctctggttgaatggggcctcagagctgttccacctgaaatttcatgatttgggattttgaaagtgccaatcatacattaaattgactttttagggttttctttttttgcacattgtatgctggtatgattaaaccttcattttaacactgtttttgtttgtttgtttgtttgttttgagatggagtctcattctgtcacccaggctagagtgcagtggcacgatcttggctcactgtaacctccacctcccaggttcaagtgattctcctgcctcagcctcctgagtagcagggactacaggcacacaccaccacacccagctaattttttgtatttttttgtagtgacggggtttcaccatgttggccaggcttgtcttgaactcctgacctcaggtgattcacctgtctcagcctcccaaagtgccgggattacaggagtaaaccaccgcgcctggcctcattttaacactgttaagggttgttttgttgatgttctcagagtgcctttaatggttatgaatttcattttgaagaaaaattaggttgctacacaatttcgctgttggttttcatcaaaagtccattgtattaaagcactcatcctgagttatggagagaattgagatttagccctacactgaaagaaatttaaatgggaagtttagtgaccttatgggattgtaattggttttgaggttttaaatgaaaaatatgaggcgggagtatgtgatgctttccgaacaaaaacaatataccctcatgcaataatgaaaaaggttctagattctgtcagttgattttcagtttccacttgcaagattgaaaagttcaattggatttcaggctttattattttctagcatatttttgcataaatcattacccttgcctggaatttccaactcctgcctttcactgatctgaatctgaccccacctcctctctcccaggagagcagcagagtccagaagaaatcacactggattaaaagtcagagagataattagactcctcccacttaataggacattggatgggtgggtcacttgatgttttaaagtctccatttctttcttttttttttttttttgagacggagtttcactctcgttgcccaggctggagtgcaatggcgcagtcatggctcaccgcagcctccgcctcccagattcaagtgattctcctgcctcagcctcccaagtagctgggattacaggcatgtgccaccatgcccggctaatttttctatttttagtagatggggtttctccatgttggtcaggttggtctcgaactccagacctcaggtgatccgcccgcctcggcctctcaaagtgctgggattacaggcgtgagccaccgcgcccggccggtgggttattttctagattaaagaaatgggccgggtgcagtggctcacgcctgtaatcccagcactttaggaggctgaggcaggcggatcacgaggtcaggagatcgagactatcctggctaacacggtgaaaccccatctctactaaaacaaaaaattagccaggcgtggtggcgggcatctgtagtcccagctactcaggaggctgaggcaggagaatggtgtgaacctgggaggtggagcttgcagtaagccaagattgtgccactgcactccagcctgggtgacagagcgagactccatctcaaaaaaaaaaaaaaagaaaagaaaagaacccctctaaaaataatggccagcaacatttaatgagcatttattatacgggaagttcttcccacacatttcatgtaaccatcacagcagctgtttatcacaacacatttatcatttattggcagtttttttcatccccttttaaaaataaacactcatttttcttccaacttgctaacatttatttttgctccccagttttacaaagtataattaataacaaagctgttgggattgtgtgacaaagatactttatagaaatatatatgatttttacatactcacatgtaccacataggtttgcctttggaaccagatatatcatctagatatttgggatgaaaaggaaaaacaggcaacctagaagatttgggagaaggccgcagataagatcaactaggctctggattttaagccttgttgtggaacactccctgatgtggtttttggtattttgctttttttggggtgggggggagcactacaaattcttttattgcaatataatttactaataataacattaatcattttgaagtgtaatctggtggcattttgtacattcgcaatgttgtgaaactgtcaccactgcctaaaataccatcacattttcatcactcccaaaagaaatcttgaacccattagtagtgtttcacaatgtctcccatccccttcattccttttttatggctgaacattatttcattgtatggatgtataacgccatattatatttatccagtgtgatggttaatttttagtgtcaacttgactggattggggaatacctagagagctggtaaagcattatttttgtgtgtgtctgtgagagtgttttcagaggaaattggtgtgtgagtctgagtggactaggtgggggaagatccaccctcaacgtgggtgggatcctccaatcccctggaggccaagacagaacaaaaactgaggtgctcagtatatgttactgcttccccttcatgaacttgacatttcttgagtgcttactgtgcacaaaacactgtgctaggccctttgggggctacaagaagaaatggaacatagccctgcccttaagaagcttgtatcctgatggatggactggaaagggagggttggcgagagagggcatcgggagggtagagtttcctgtgcctgagggtggtgaatgagagagggaaggacccgaatgtgaagtaaagaggaaaaaggtctgtgagaatcagagcactgatggaattcaatggaaagattaatctgtgtgtgtgttgggggtggggctatggggagcagctcatggagtgccttcctttctttacccttgtattcctcccacaactctagcagaaaaatgggtacaaagatgccttaaaatgttggttgtttttatagacacttctggtatgaggttaaaatattctgcaaattgggaggtttccatcaatgggacataatattcgtggccctttgattcagcaactttttgagtccctcccagtctttagggtgccagagattcagagataagacaagagtttagaggacaagggtcaaatgaaaagacccaaagcctggcagggtggtgcacacctgtaatcacagcgactggagaggctgaggcaggaggattgcttgaggccaggagttaaagatcaaccaggggcagcatagtaagacccagtccccctgcccctgccttccacctccacggaaaacaaaacaaaacaaaacaaaacaaacagacctagacagtagcatgtaggacagtaacaaccttggcaaaggtaaacactgtggaggaatgtggcaggtgatcagtcattccttctgcagactgttttggggctcactctgctgagctctgtcatacagagagtagccacagggagggccctgccctgtagaatcaccataatctagaacactggttctcaaggtgtgggccctggaccagtagtgtcagcctcacctggaagcttgttagaaaggcagattctctggctcaccccagacttactccatcagaagttctggaggtgatgtccagcagtcattttcacaagccctccaggtggttctgatgcatgctcaagtgtggtgagcagtgggctaggacagttgtcaggtctggatgcacattagaatcacacgcggggcttttaaagcaacagtgcctaaaccacacctaagactgactagatcagaatctgaagggagacccaggcatctatatttttgaaagctctccaggtgattccattgtatagccaaagttgagaagcggtggtctccacatgcttaaacagatcatcacagtgcaaccaagagtgaccattaaggtgggaaacagtgcctgtgagtccacagagcagaggatgcctggcaaccccttgaagggatcaggatggctccccagaggaggtgaggacccttcattgtatttcctattggatgagctcttcattcctccttccctttttttctggacattgcagttgcacaaatctgagtgtgatcggaaaggttattttaaaattcatttaatgtgattaatttttcaaagttgaacacagctggcttccctttaaaactttgtattttgatagtggttcttaccatgaataattgactaatatcaggtcattaatattctataggagagtacttcaagctaataaaattcattttaaaattagtttttaaaaatgtgttcctgcagcccagggatagtaggatctcagtcaagtatgagattttatgcttttctgttaacataagatagttgtttgactgctcagtatccctgttttattccaatttttttgtaggaattaattgcccaggaaaagacctctgtttcagagttgcaagtttgcctggatgctgttgccctgggaaacattattgcatcaacagtggggaaggggtggctctgacatgggtgctctttgtccttctcctgggtagggcatctctgagagggtatcccctttaggtccttcccagggcttcacatttgggccagatttttttaaaaaataattaaacttttgtattttgaggtcattgtcaatccacacgcagctataagaaatattataggctgggtgcagtggctaatgcctgtaatcccaacattttgggaggctgaggcaggaggaccacttgaggccaggagttcaagatcagcctgggcaacatagtgagactgcatctctacaaataaataaataaataaataaataaataaataaataaataagaaaaaaattgccgaggccaggcgcggtggctcatgcctttaatcccagcactttgggaggccgaggtgggcagattacgaggtcaggagtttgagactagcttgaccaacatggtgaaaccccgtctctactaaaaatacaaaagttaaccaggcgtggtggcgcatgcctataatcccagctcctcaggaggctgaggcaggacaatcgcttgagcccgggaggcggaggttgcagtgagccaagatcgcaccactgcactccagcctgggcaacagagcgagactccgtctcaaaaagaaaaaagagaaagaaaagaaaaagccaagcatggtgacacatgcctgtagtcccagctacatgggaggctgaggtgagaggattgcttgggcccaggagttcgaggctgcagtgagctgattgtgccactgcactccagcctgggtgacagagtgaaaccctgtctcaaaaaaaaaaaaaaaaaaattacagagagagcccatgtaccctttacctggtttcccccagtggtagtatcctacaaaactatagaacagtatcacaactaaaatgttaccactgatacaatcaagacagagtacatttcatgatgccttttatagacatccacttccctcccacccctaccctctcaacccctggcaagcatgtaggcatggatctgttctccataagttcttatggagttcaaaggtaaaactgggtccctggttttaaaaaaagaaagagatggccatagactgtggctcatgcctgtaatctcagcactttaggaggctgaggcaggaagattgctttagcctaggagttccaacatcagcctgggcaacatagggagaccttgtctctactgaaaaataaaaaaattagccaggcatggtggcacatacctgtggttccagctacgtgggaggctgaggtgggaggatcacttaagcccaagagttggaggctgcagtgagcaatgatcgtgccactgtactccagtttgggcaaccaacagagtgatatcctgtctcaaaaagataaaaaaaagatgataaatgcacacaaatagggcacatggacaaaggatgattgggtaggaaagttagacattttaggatttcaggccatacataaagactttcttttggaactgaattcagcactgtattagtctattttcacactgctgataaagacatatccaagactgggaagaaaaggaggtttaattggacttagagttccaaatggctggggaggcctcagaatcatggagggaggcgaaaggcatttcttacatggcagcggcaagagaaaatgaggaagatgcaaacgcagaaataaaatcatcagatctcgtgagacttattcactaccatgagaacagtatggggaatactgcccccatgattgaaattatctcccaccagttccctcccacaacacctgggaattatgggagtacaattcaagatgagatttgggtggggacacagagccaaaccatatcaagcattacttcttggatacactgtgtctttagagggcatctcctggtgttagtgttcacagtaatctacctcaattcctctggtttaaatctggctgtgttttggtaataactggtttatttgttagaggccatggtttgtgctccagccctccttacctcggaatgagctcaagggctttttgacagcctttgggagaaacatgtagagtcagaaggtggaagctggagatgagttaatttggcttctcttggaatggatattctcaaaatgtttgctcaacaattaagcagaagaagcagatgctgtgtggaagaagctttactcatccagtaaatctcaatcccgactgaactcagacttccttatccacatgtgccccagagcagctagacgtgcagagagagaatcacaggagggagctgccaggcttctcactgcagggtggtaaccgccagccacatgtggctattaagcgcctaaagtgtgcccagtgtgactaaagaactgaactgtaactgtacttaattttgatatgaaatttaaatagccatgtatagctcatggctaccaaatgaacacagagattccacattgcccatgttgggctgtttgagtcactccacccctttcagtgggataaaactgaatttaaaaaagaaagagacggccatgcattgtggcatgagcaaggagaggccttacagcttcccccagggtcctctgtaaccccttccccacccagcatcagccctaaaacattgctgagcaaacattttcaaaccactagtgtgaggaggaagctgctaattagcctgcctggacaggagccacatctgtgtccagctgggccagcgcttggctcacagtactgcttacttcatactgctctaatgagtcacacttgacttctctttagatttgcaagctcattcttggggccaggttaagatttgttccctgcatgcatcacttcgttacagcactaagactaaggtgttacatttcttcccgtgccagggaagcagcacagaaaagcggtaactgagaatgtgggtcctttccgccagatgtgagagattaggaaaaaaaaatttaatggtttttaaagtgggtcctgaagccagtttcttgcattggaatctggcttcaagtgcctctgtttctacacctgtaagacaaggatcatcacagcacctctgtcatcatagggtggttgggctgagaaagtctgagcagtgcactttgtccttgggaactgctcagttattacctcttattatgatgatgctggtgatgatgactgtgagcatgataataaagattttctggaaagatgatttgaaggtgtgactctcatgtgtgtccatgagagggcagcctaaaatcatgcatgtctgtggaacaagcagcctctgtaaagcctcaaggtaatgtgggcagtttcaagtgtgtttggccctttttcttctctgtttttcttttttccctctgtttgaagagcgctttcagccattttcaggcttactttagatacggagcaggcccatgaacacctagagggcagcatgggcagtacagagctaggttcaggccctgcctgggtgggtgagtttgtgtaggtgccaatgagagcgtctgtctaggcgtcctaggcttttctttgtaacttttcacacagaactaattcttattaatcagactcttgaggtagacactagaacctgactgtgtttagagaaaaaagaaacttgattttctatgcttgttccccttccactaacttcacacctgcctctgagcattgtgtgcatgcattggtgccaccatgtaaggggacagtggccggagctgtatagacccagagttgcatcagccacacatggctctggaacacaccaggggagactgagttacagagagagcagaataagagtcctcaaaccatgtgggagcacagagcatcatagggctgggggacagtgggggtcttgaagatgggcagggtttaaacagatggagcagggtagaataaaggatggcatgagctagaaggtgcatgggagaaagggcagtgctgaggtaaagttgggaaaagagtttggagtcagattgcggggtggctggaatgagctgaggagttggcctttaaatttttgatgacgttcatattgttgatagtgtcataatgattaagagatgaccaaaaacaaaatgaagaatggcacttggatttttctagtacttatctcattttaatatccctgatatttaatctaggctgcaaaaccagatgtatgtggggaatcatgacaatccagtgtttgtcacgccatcccccttcctcattcccactgcctacactgtgggccaggccttcaggcctccctcctggacagcagcaggaacctccttagaagaagcacaggttgctgtggcagcaaggcacactatgatgccaacttgtgatgctcccagagaggaaggcacagatgctggggaagtgaacctggttatattaacatgaaagctgacttctaaagaatggtgtgcttctttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcaccactgcagtccgcagtccggcctgggcgacagagcgagactccgtctcaaaaaaaaaaaaaaaagaatggtgtgcttaaatattatatacataatatactgggtccagttgtaacagagtgcagtaaattatttgtaatcctaaaatgatcatgaagatccatttaatcttttgtttagaaagccctttagggttctgcaggggttggttggagatgaaaagctccagggatatttctcagacattttcggggaagttgtcatttgttccatcttatttgttgtagatatttggatgattctaagatactaagattgacattggcacaaacttggcagaaccaaaattgaacttgagtgttgtctttcatagtgctcacccaaggagctcatacgttggctcctttcagaaagtaggccgggcatggtggctcacacctgtaatcccagcactttgggaggccaaggtgggcgaatcatctgaggtcaggagtttgagactagcctggccaacatgatgaaaccccatctctactaaaaatacaaaaattagccatgcgtggttgcacgcacctgtaatcccagctactcgagaggctgaggcaggagaatcgcttgaacctgggaggcagaggttgcagtgagccaaggtcgcgccaccgcattccagcccaggcgacagagtgagactctgtctcaaaaaaaaaaaaaaaaaaaagtaaaatgttcagtgtctgtgtaatgagcagtattcaaaattttgtccatttttgtgcttctcctctcccccaggtggtcctgcttcaggcttgggagcctgactagacgaggcctagtgggcttctctgcacactgccaggcccgtctgtcacttactgtactttctgaccccttgtctgcctgggggcaaaggattaaggaaggggctttgtcctctggggctgatgttggcccaactacaggacagcttggcaggtgcatgcgaaagtggtagctgctgcccctcagctgtgtgtgtcatggagagtgacagattggacttcctttggttgaagtgatggagatggatgatgtgcacgtgcagtcagactcgggtgccatgcccagttgcctatagtacttagcagatagggaaagagtgaagaactgaaacataatctagttttctcctttgtaggcatggagggatttttgaaatcagatgagaggcagagattggccaaagaaagacgagaagaaagagaaaaatgtctgggtaagttatgcactttggctattttggtccaagggagtggagatatggtggtgtcttttctgaagattcttagaaatttgtgaatgaatgggaactaggacagttgctagatgaacatgaagaatcaggcgtgaacctacactgcaactggcatgttcacaaataggtaattttcagaatagttcactcggcaaacattgaacctctgctgtgttctagccactgtgttagggtctgcagttacgatattgaagaaagagaaacagtcgctgcccctgatctaaggaagtcctaacaccttcaagtgtcaactgtgtacactccctcaggttctctcttgggaatctaaaagggccatcctcaggagaactgagaaaatcagcacttgagtcattttatattttaggacagagagccctggttgagaaaggccgtcttgcctcttgcaggctgtagacagattagtgcagagtgttcttcacaggatgctgagggagatagcgtttccccattgcattgagacaaatgaggagctttcaggttcttctcttcttcactgcctcctgctggtcggtacaagcattgcctcctccagggaacccttccctgccttggctaggtggaattaagggccccttagtaaatgccttgagggtaaggcaaattttgttcgtgtgttttaccccctgacttagctcagtgtctggtgcttggtgcacacacagttaaactgcttttgaatgaacatagccttataagcatcattgctcaacctagcatatagtttagccattatgcacaagtttgacttaatgacagccgtcatagtcatagctcccacgtggggaggcacttactgtgaacttcacggtcatcatcttgttcaatcttaacaacactgtgatgtggcaaacatgactgtccccacatcgtagaggaggaaaccgaggcagagagatgatctagctaacatgcttagggttacccagctagtggcagaggtaccagaaccctttatctcaatcactgcatgctaggatcctaccaggctctttttagggctctgctcttgcttccttgtttttggtcttaatccaaactgcatgggatgctctggtaatgacacctctcttctactttccttccccagctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggtaaggcccaggtgcaccctccgccaccttccagccccctcagcaggctgctcagagtgcctgggcatcctgcccagctctggggtaggagagagacctgccgtgcaccttctccttggtggctcccatgccttctttcagcaacatgacatgaaactcgaagcagcactgacatagaaccgcagagacttatccattcaactcaggtgttaatttgctgtgtgatcttgggcaaactggttggcttctctgggccttgatttgtgtgtctgtgaagtgagggttggatttggcagtctccaatgcctcttttagtcataaccttttctgactctaagactcaaagggtccctggtggtctagtagataggggaaaaaaaaaaagactcagaggagattgtgggtagcggctgggtgaggtgaatctgaggattacagatgggagttcatgcctccagggcaggcacaaggccagaacaagagcttgtgaggttgagaacaatgtgatcctgtcagttgctactggcaaattagtctaccctcaaataccaagatgctaatatatttaaagtttaatgtagttcttcgctttaattgctctttccagttaccttttaaaaaagaaatggcacataattacccctacagagttctttattactaaattttgaaaatatatttagaaagcatatttggattatagattttcttcacgattatatttttaggaggtaataaaaaccttatgtcagttgatgataattttttattcataaggtataatgattcatcttttagtatgaacaatatagaggtttggtaatctccaaccctataggatatgaagatgtttgtacaaattcagtattttttaaaatctctgaacagttgcttatcactatatatatttaccccttccttcttttttttttaaagaacacatacgaaaacacacacatagtcagacccatctttgcccaagaagcaccctttcatggtgatttctttcctcctcttagaaaatgaggtctaagccagtgtcttagctatggttcaccgttattggctgcagtctgattgctgtgccttcatctgctcccagttcaaatgtcagctccaatgccagctctaccactgagcagctggtggccaggggcaagtcacatgcccctctaactctgtctccttagcccaaaacagaggtagttacaggaattaaaagaggtgacttttgtaaaagtgcccagcaaagcacctagcacagagtaatcgttcaggaatgttacattctgtttagttacttcagctgagcttggctaaagcaaggtcaagagggtgctacccacaaaagcttatgaaacagagtcagtagatgggaaaaagccacagtataataggctgttttggtaacttgggacagatttctcctttcctaacttctgtgttaagagttgctggactcacccattttcttcccatcctccattccttgatgacttagagcttgtcctcttcttccatgatctctccattttgaaagcttgtcactgctgcttccaggaaggggtactgtgaagtcacataagacacttcccatgctctgacatatgcattgtcactgggggctgcttttgaggcaatttctgtttataatttttctctacagaacattagtgctggaggcatgttaaattaagtagaacagctcccccttcttggaggtgagggagttttatgccatatggttggtcctgatgcagctgaatcttttgtggtttcccttctgggtaattttctatttgtgtgcttccttgcacccctaatgtggtggagggaagcaggaggctgcccgaccgacccttgtcagcccaagctgagcttggttccctcttctccctgggcacagcagggcagggctgagggctgggcctcctgtggttgtgtagcaacccaaggaaacagcagcctccttctgccacctgctcctgccctcagggtcccaggggacccaggtgtagcttagggacttgccacacacaggctggcttgttagctacattgggtcggtgctctgctggcacagaggcctttttggcattctcgtgggtgacatttagggagaagggatcagcctgcattacggaagcccctcttcaaaggaaaccctctgcactggcccctatgattcaaggggagctctgggagggctgcagcctgctcagtgcctggctgtggatgttctccattctcttctcagtgtcagattgaagtctttttttttttttttttttttttggtcatgttctgtctctgtcagccagagaaaagcctctgcaggaagatcattcatcctatgcaggccattttacttctctagcctgttggaaagtgtttgttgcccaccaaatcctgcctctctgggtctgatacttaggagctcatgagaggcctgttgaccccaccccagccctgccctggctctgtacccctatggttgccatgatgtcactcttgataacccctcatgtctgtgccagggcagaagtgggtaccaccaatggcctgtctctcagaggtcttaagagttggcagaggtcttaagagtagtcaggcctgtcccagggaggggtcccagggaggggtggggtggttctactgtccacttgacaccctgaccttaaactcattctcttgctggaggccacctactccttaagttcttagaaccttcacgtgccacacagctcccaggaaccaagctaccagaacaagttcctgtcacctgtgttagggctgacaacacagtatgccagcccattctcagggcagtatagcttcctgaccagtggccctggaaaattggatttggaaaagccaacttcatgttccttatgctaaacagaaaagagaaaggcctctttctctttctttctttctttctttctttctttctttctttctttctttctttctttctttctctctctctctctctcttttcttttcttttcttttctttcttttctgcacacatccctgctgaggaccgctgggggtgtgtccctgcagtgtcatccccagaacacatgtaatgggccgggcatggtggcttatgcctgtaatcccagcactttggggagccaaggcaggtggatcacctgaggtcaggagttcaagaccagcctggccaacatggtgaaaacccatctctactaaaaatacaaaaattagacagacttggtggtgctcacctgtaatcccagttacttaggaggctgaggtgagagaatcacttgaacctaggaggtggaggttgcagtgagcagagatcgcaccactgcactccagcctaggtgacaaagcaagactctgtctcaaaaaaaaaaaaaagaacacatataatggcagttgaaaaggcacagccaccccctaccacccattcctgccagagactgctgtctgagtaacagtgtctggaatgtgccctgctggcaacctttaatactgttcagccagttcagcggggtcaccttggtcgtgattctccaagttcatccagacagatctaaagccagacctcaaggcatcaagtgtgaggctcgctccttccttctttccttccttatctccctttccttcctttctatctttccttccttcctctctttccttccttctttttttccttccttctttccttccttccttcctatctatcctttcttccttcctgtctttcttccttcctatctttccttccttccttccttccttccttccttccacccttccttccttccttccttccttccttccttccttccacccttccactaagccctacctaatagaggagattctagggacgaggatttgccttgccctttccccatcctctgttgatcatcagatgatactcaggagaaccagaacttggcaggaattgcagtatgcagttctgatatttattaatactgtttttctaatgtgatggaactttctcatgctcactttctgttgctcagcctttcctctaaccagtggctcttgcttgggggtcccatgaccagcagcacctgggaacttgttagaaatgcagattctcagcaggctccaccccagacctattgactcagaaactctggggataaaccccaggattttaataattcctccaggggattctcctacctgatctctcagatttgagaactattgctctaaatggtcctgataagaatcttcctctttaaattcagattcacttagctttggttaaggacttactgcatactagtcattatcaaatagacttagagtgatctggtgatgtaggtaagctcatccccattttataggcaaggaaactgaagcccaggactgcaatgttagctcaaggtcacagggataaaaagtgtcaggcagaggtgggatttgaatccttacctcctgattccaaatctgagatcctttctgtttcgtcatatgaaggaacaaaaaggtacacacaaacacgaggcaatactgacctattcaggactaaccttaaataagacttgtgcactggacaagttttgttttctatatgtatgaatcaccccattctgactttttggggttccataaatcctcttctcttagaacttgcttatcatctatttctcatcatctctccaaaagtgggtgatacaaagtgagtgtgtctttctctcagggacaactgtgttttcatcggcctcctcaaggtctgaaggaatgaatctccagtggtgggatttggagcagctcagtggactggggatggatggcaggggtagtttttctagaggccattgaaaagtccaggggcaggtctggctttcagtgagcactcattcccttacaagggtgccccccagatagctgatcagtggtcaggctggttcagtgaagctcactattctttcttttcattggtcccctagtagagaagggaccactttgtgaggtccttctggcatgtaggaaatctaccgtaacccacccaatacttaattcactctaggatgaaaggtttcaacacttcagttaggtcattggttaaatactttacgttaaaccgtataatgaaatactattcagccccaatctcgagtggctgtacttcaggcatcacatggcagagaagttctcttccttccaagccccagcttttatcaggcagactgccagagttggccatcatcgtttaatgggccagggtcgtgaggactggactctgccaaggcatgcatactcacgattgtagagtctcaggccaaatacaagagcacagttaatagctaatacaaatctaagagttacaggaggtaaaaatccccctttctgcttacaggtccctggagaggcagtctcttagcaaagtgctattcagagaaaaattatgtagaggaggctgagatgtggagaagccagatcctcatctcatccctctggtatagacagaagggataaatccagatacctattaagtgacctttatatgtttctagtaagtgtgacataaaggagcctttcctgatctttaagtcatggttactcagttgatgatgtcctaaattaattttgcttctgtgtgtatttttttaagccatgacaattgtatctttttgttttagaatgggctatgattagcccagttcctggagcacctcggggttgggttttatgagggcaaaagggtgtcattataactgctagctcaggccttctccagtggagatagggagaggagttggtatttgcagtgtcacggaggtggtggggagtgcagaattagagcaccttcactgcagcagcaaggacaactttatgaaagtaacaatttgggtaatacaggagagtgtttttgataaatactgttacgagagaagccgaagcctaatggttgtttttctcttctggttaaaaattactgggttctgcctccctgcctcctccacctaagtaactctgggaacgcatggatgcttttttttttgtggccagaaggttctttactcttgcctcttgaaaattttgaaatatgcaatattatcccagattactatatagcagaaaagcgtcacactatgtaaaacagttggttcccctttaagaagttctaagatgaaaatgcagctttgcaaaatagatctcagtgtcatgtatcaccccaaaaactcaaattatatttgcattaaaattttctcaaagcaaaatgttttatgcttttaactagaaaggatgctcttggttctggagcagaattccagctctcctggttagggcaaaatgccttgagataggcctcaaggagttaatgcttattgggcattattcctagggcagcttctccccagggaggggaggggacaggacacacggtgtttaggttgagagccagtgctagcctagccgcattgtttactctccacctactcagaacacgctggtgtggcagagagagcacgtatgcctgggttttggatgctgagcacagaaagccccatttggtgactcacactgtgcactgaggcagcaggtagtgtggtggggctgggtagttaatcttgttaacacttgccttacacgaactgtgtaggaacggctggaggcgatgatgcgccggtccctggagcgcacacagcagctggagctgaaaaagaagtattcgtggggagcaccactggccattggacccggaggacatgatggtgagtgtagggttgcccctgtatttcaggtcctgggtgggaaataatggagcaggcaggggattatgggcaccactgggtgtctccaggatctgggggatgctttgcacagcttttcagaggcaccactttcagatgtgatgtttaaaactgccaagattcctacgcatgcatttgttatgaaggggatctgtgcattcttcttgatagcaaacagcagttgacacaaaaactgggttttgagggagagcaaaagagaagactttgaacgcagagcccagtgagctgggcccagctggcaagcccagggttgttctgacttcaggggagggaaacggcaggaggctctgtcactggtccagatgcgatcaggaaaagcacagtggcagttatcctccaaaaagggctggactatttcctgctgcattttaaatttttgttgctttttcgactttgtttcaaggtgacttatttcattaccagttcaaactcatctttaaattttcaaatgtgtaatttaatatatggattgttactagtctctggatggcttttccttcttttcagtgtctcactacatttcagcgatcttagcattctattatgcaggaggtgtgtactagctctatctgagagcaaatggatttgtgtttacaggacagttcttgactttgctgtattgtgcttttcacctttgggcagtaaatatactttattttttcttttttgaaaagtcaacaacccatttcagttactttttctaatttcctaattagaaactaagaagcaacaagaaattgggacttttttcttttacctctctttgctctgattttttgctgtgtaggtgaatcagaaaataccccaccccctcctctaggtttagcagccagcaccctccctccggatgcagggaccactgccgcagctgccgagtccaccaacggtatatccgagcatcactgtgccatagcattttgtgataactgttctgatcatcctcccccatcaccatgtctgcgtcaagcacttttacaattggtttcttagtctggcctgtcacaatttttttttcctagcaatgtgaatgacatgcccatatttctttgttcctctgtcattatagagcggtgcatgccttacatcttagtgccccggagacatttcatcctcaactcactaacgtctgccttgaaaatcttgtcagtgttggatttttgcacactcagatctttaacaatctcttcatcatctgttgtagacattaagaagcagggcatttctgattacttctggttaccaaaacctgtaatcacccggagttctgaatggagaacttgggcttagtgttaaagtgatagattcctggagaggtgtttgagagggagtggtaggaattttatcagtgctaacactggtaatccaaataattagataatttggctttgtgcttgattttatttaataggctgtctgttttgtatacaggcctgggaaactcctctggtctagatcaagaacagaactagccaaactttgtttccatttaataatgactttagaaattcaatccatcttcaactggcaaagaaaaaaaaaaaaagctgtaaaagggatgcaatatttaccaacaatgcggaaggtcatattagcagtaggaatcaatatccttggtttctgacattcctttgacaatgaataatccttactgggggtgcttcgtaacagcagttttgctgcacaagcagagttacctctagtgtgggcactggctttccccctaagaaaggtgcaggggggctgggcgtggtggcttgtgcctgtaatcccagcactttgggaggctgaggcaggcggattgcttgatgtcagtagttcgagaccagcctggccaacatggtaaaaccccgcctctactaaaaatacaaaaattagtcaagtgtggtggcgggtgcctggagccccagctactcaggaggctgaggcaagagaattgcttgaacccgggaggcagaggttgcagtgagatcgtaccagtgccctccagcctgggcaacggagcaagactctgtcttgaaaaaaaaagaaaaaagaaaggtgcagagaggtggagtaatcacccactgggaatcagcacccagggcccgggccagggtgaaatgagtgcagtacttgactagagcatacaatttaagggagtgccaaaaatctcagtaataaagataaaataatatcttaatgtgatattttttaaaatccaaattaatgcaaaacaatccataataaacaacaaatttctaaagactggtgccatgctgagcacatcagagcctgaagcaaaagggaaaatgtgtactcctatatacgtggttttatgtaatttctaatgtttagttttatcaaaacattaaagtagtttaaaatatggaaaaattgaaaagagtattaaaactcatataatttcaactttaaatagttttatttctacacaaatcaaatttattgtacttttacttcagctttagttaattaaaaattaccgggccaggtgcagtggctcacgcctgtaatcccagcactttgggaggctgaggcagatcacgaggtcaagagatcgagaccatcctggccaacatggtgaaacactgtctctactaaaaatacaaaaattagctgggcgtggtggcatgcacctgtagtcccagctactcaggaggttgaggcaggagaatcacttgaacccgggaggcggaggttgcagtgagccgagatcgtgccactgcactctagcctgggagacagagcaagactctgtctcaaaaaaaaaattatttaagattgtcatttggtcagcagaaattatagaacatcgcagttcttatggcagttctcatgggaaaacacgatgagcagaggagtagattttgaaaatattattgatgagtttgcttttttacaaccaagagcacacatttttcttttggcctcaggctctaacttagcttggcagggcactgtcagcatctctttgtttgccgtctgaaataatgactggaacgtaagaacaccaaactcagggtcgcctgttaaaatgctaacctcaaacagttaaagcatttgcaaaaggaccattttgatctgtctcttactaagtaagaaaaggaaaaccaactgctaaagaggccgttctgctttaaatacaactctgagaggacggatttcatctctctccaacctgagctacagataaccttcataaaagagtcggtttcagcaagcggtgacagtcagaccatagggcgttttccagtggtgatttgtctctgggtccaagttggttttgtttttgtgtgatgtgagcatgctcaaaaatccctagacaaaagaaaatgatttgttggtgggattaacacggcttcagttgaacagttgagtgaggttgaacatttgaaattgaagatgacaacacagtgaagaagttgcagagattttgctgcagaccaagggctgctgtagcctggtcatttctagagtaggataatgagatgccaggatgatgaaagcagagcatgctgtgccacagcatttaggaggtgcgtggatgaggacaggaaggacacttcgggatatgtgtttcttggttctacagtagtgtgatgaataccaatgtctttaatgcatttctctgcagcatgtgacaaactttcaacatcaactatgagtttgccaaagccaacggagcctcccatgaataaacgcctgtcttcatccaccgtggcaatatcctattccccagaccgaggcaagtgaacatgtagacttggtctctctagtttgtttcttttctggtgtgagcatcttaacgtttgtctttgtgagagtctcctcttgagccttctgcagataccgtcattgtcctagtcttgtggtctgaatgtgggagctctagggccttgtcagtgggactttggaacgtggcacggctctttagagccaggtcgttgttgaatagaggtaggaattaatgcagtctcccagtctgaaagagactgttctgttttccacattgcatgtaggagttatcctgcccaggaattaattaaccagtgggcagatgtgaccattaaagtaactgcctggtcaatgatggaatacagttgattagccagaaagagcagaattgataagttatagttatatgggaggcttagatatgtgaaaaaatggggttctgcagtcatctgtggtttataggcctgcccattttgtagatgaaaagagaagcacagaactaatgaggcctctaaaagaggaaaaggttgggtggcgctctgttttgagttaggagatgatgtgtatgggacgtgtgccagttccagaacctgagtagatttaacagggtctgcattctcacaaaggctcagataagtcactgaaagtctgtttatacctttcagagtatacaggttaaggaaatgacggaagctctccatgcactaaatgtttattctaaagcaacattgaagaagtatcaggtgccagtggagtgtttagcacaagttatcaccaagggcagagcaaaaggctggttgcgacttggcagaggctggtgtgccttcctggttgtttccactgacattgaccttgtacctctatcccagaggcatattatgtgtgtcagagaccctataaggttcataatgctactgatctgtgatgcagttcatggtaagcaccaggaacctggaagtgatgaagagctgaatacagagtgagggaaaagttaattcattgccatatataatacattcaaaactgatctaaatattttggtcattgacttccagattatgaatactactatttgtctttcattaaagctgataatcagttggctgtttgtatttttgtgcctctcacttaatttttacccttattgacatgtaaaaagtatgaaaagatatatttttatactattacaagatgacattttatttaaaaatcagtgtgttatgaaatgcttcttagcgcaggacctaaaacaagtgttttataggcataatttgttttctacttggagtaaaggtttttttgttgttgttttttttgttttttttttgtttgttttttttttgagacaggctctctgttgcacaggctagagtgcagtgatacagtcttggctcactgcaaactctgcctcccgggctcaagccatcctctcacttcagcctcaagtagctgggactacaggcgcatgtcaccatgcccagctaatttttttgtattttttgtagagacgaggtttcgccacgttgcccagggtggtctcaaattcttgagttcaagtgacccgactgccttggcctcccaaagtgctgggataacaagcatgagccaccatgcctggccataaatgatttcctgagtccatattacatctgggaggtgggctaattctctgagtgatacaggttactgtactgcaatagcatattgaatggattttggtacctagtgacaattaatgcactctcccaaactctaaaggacacattatttgttttattttacgatgacaaattccaaatccatcctttgttcaaatatttttattttccatgttctgccacccaaaagttaatttgcaccatgcattgtgttgtttaaatgttttattttgttttgttttaattttgctttttaaaattttcatttgattccatccctcagctcatcacatgcaccttagtccaatggaagccattcttgtttcgcgactgttgacacccacacagtcttctttagccagaagcagagcttcagtcatgctctctgggcaggccaatgattcaggtaaaagaggctaagctggtaacaccaaggaaaatgcccgaagaggtgttggtcagcctaggatttactcctgaatttttggattttgcttcctatttgctggctttgtgaaaagtcttcattggttaataacgtcttataccagtgttttgctgttttatgtttcttttgagtgtcacagaggtgagtaaattatcttatgagtgagagcatgttctttaggggaagaaaaccccacttgatgaactctggaggttagtagacttttcttaagagacggtgtggcaaaacagcctgtagaccagtctggggtgtcccatagccagctctaccactcactagctctcaccattgggggtaagttaattaacttctttaagcctcagttttctcatctataagatggagctattttaaattattttgaagattaaatgagagagtgcatgcaaatgagatagcacaatgattagcacagaatgaaagctagaaactttgagaagtttctagcctcactactcaaaaggtggtccatggaccagcaatggcagcagcatctaggagcttggttggaaggccccacctagcctgcacactgaagtctgagaaacactggaccagaccatcaaagccctgcctttatcaaagcagatcaagtcgtcatgtcaggatttgtggcggctggcattctctttgtttccagatgagcagcactgtgtccacctaaggtcaggtctactctctgttctccagatagtgtactcagttgtgatgatacataaatgagataaaacttctgcctagttgtagctgcttccaaacagttatactgtttctgcaaataagttgtacagatagctaataggttcataagatgctcaacatcattaatcattagggaaatgcaaatcaaaaccatagtgggatgccactttacacccactaggatgactagaatttttttaaaaggggaaataaccacgtgttggtggaggtgtggagacactcttccctcacacactgctggtgggaatgtaaaatgatgcagctactgtagaacacagtctgaccgttgctcaaaaacttaagcatagagttcccatacgacccagcaattccactcctaggtatacagccaaggaaattaaaaacatatgtttgcacaaaaacttattcacaatagccacaaagtggaaagaaaatatgatatacccataaagtagaatattattcagctataaaaagaaatacaggccaggcatggtggctcacacctgtaatctcagcactatgggaggccaaggtgggcagttcacttgaggtagggagttcgagaccagcatggccaacatagtgaaaccccatctctactaaaaatacaaaaattagctgggtgtggtggtgcacacctgtaatcccagctactcgggaggctaagacaggagaatcacttgagcccaggaggtggagactgtagtgagccgagattgcaccactgtactccagcttgggtgacacagcgagactccatctcaaaaaaaaaaaaaaaaaaatacagatacatgccacaagatggatgaaccttgaaaatgtgctaagtgaaagaaaccagttgcaaaaggccacatattgtgtgcttctatttatgtgaaatgtctgaaataggaaaatccatggagatggacaatagatggtggttatcagagactggaggagggaaggaaggggagtgactgcttaacggacgaagtttctttggggaatcttgaaaatgtttttagaagtagactgtggttatggttccacaaccttgcaaatgtagcaaaacctccaaattgtatgtgtatatgtatacgtatacatatacgtatacatatatgtatatatatgtatatgtatttaaagacagggtcttgctcttttaccctggctagaatgcagtgatgtgatcatagctcactgcagcctcgaactccaagccctcctctcacctcagcttcccaagtagctgggactacaggcacacaccaccatgcctggctaattttttgggttctttggagggacaaggtctcactatgttgctcaggctggtctcaaactcttgggctcaagcgcgacccatctactttggcctcccaaagttctaggattacaggtatgagccaccatgcctgtcctgtatactttttaaagggtgaattttatggtatatgaattatgtatcaaaaaaccctagcaagtaggaagtaccccattttgagaataaggaatatgttggggttccctaagagcaactccaggatcagtgatttgctaggaagactcacaggatccccagtgaaaggatgcaagcaaagtcagcaaaggagaaagacacatgggacaaagtcctgggaagaccaggcacaagcttgcagagtcctctctggtggagtcactcaggacgcctttcaccccagcaatgagttacgacaacatgtatgaaatgttgccaaccagggaagctttttagagactcagtgccaacggtttttacagagggctggtcacatgtactccatgcccagcacatacccaaattccaggttcccagaaggaaagcaggtattcaacatacaccatgttgtttgtttatgccctgtgagccactcaacagttaaagggggatcgtcctaaaatgtacgttcccaggtgctggctaaaggctaaccttgtaagcaggccttagtagggacagcagtcaggcttgctatgttaactcatttttgcacagctcacccacttgacccttggccaaggtgtctttacagaaaatttttcagtagggccccacatagcagggggtgagaccatcctgcagtattgatctcagttatgtcctttaggggttctgggacttagcagttaaagcaaatctcattaaccagaaggtctgtcttttttttctctctttcttttctttttctttttcttatttatttatttatttatttattttggagacaaggtcttgctctgttgctcttagccacgctggagtgcagtggcatgatcatggctcactgtggcctcaacctcctaggcttaagtgatcatcccacctaagtctcctgagtagctaggactataggtgtgtgctaccacacttagctaattttttttttttttttttgtagagatagggtcttcctatgttgcccaagttggtctcaaactctgggactcaagcgatcctcccacctcggcctcccaaagtgctgggattacaggcttaagccactgcacctggccttagaaaggtctgtttgaggcagccaggtggcctcctccatcagttgctgtatgaatctttttacctggcctgtggcatcagctcaggcccagaacagctctggccagtaagttgaaactgatctgaatgccttccaggcctgacgccgtgtcatgataatcgtggcacgcacataggaactatgatccccaagggctcatgtggttccctggaaaaaaagagttgaagatgttagggcacactagcagggtatcattggtcagtcagttcccagtgtggcctcccactgtggtgactggtgcctcagggtgctcagtccagtgcaggtaattcagctcagtcccaggttttatggcggctgcctgaggccatcagtcccaaacagttctaccagtgaccctacttcatcttcctggcaagtgcagatggcatctggagctgttctgtggggacatgtaggaactggccccactcctgccggctcatagtcatgctgtcacatgccatctaggctcagccatgggtctgagtccaaggtgctttcagcacaaggagttttccttcaggaaggagagcgcttccaggagcagttatggaaaacagaacacaaatgtccttccgtatccctgtatcatttttaccccaggtgttggattatgttgtttttctccatgtcctattcaataatcaaaactttacattttcttaatcatcccctactctcacccagacctttcaaagaaaggacaaaagcatttcttaaaacccatttttatccaacttaaccagaaagatatattgtgttcaggtattaggctaaaatcctaagttttcgaaacattttaaagtaggtttgtatcacctctgagccctttcatcttgatcattttatccagtgagcagcctagaaaagatcaatccctttccagtgacagctgcatttaacaaattgctttactgacgtgtgtagtgagagaaaggtagaggaaatatagtcaggatctcagtctattacaaactgcagctactccagaaaattaaacacaaagcatcaacagcagtgacactttccccagagggaatggagttcagtctgtcagggatggctgaaagagtcacattgcctgtggtgtgacttggagcttttgtaggaatcatgtgttgggaatataatcagactctgcatcagaaataatagagccaatgagcagcttgattgtggatggtcccatcagagaacaagccctgtcttgtgggcacttgtatgtgacccagtctagcagcatccagaatctttttacagttttgggccccatgaagggcattctatatttgtagtggtccctactcgatttttaaaactccagaagcatgtcttttcctagaaattgcctgtcttttcatatctccccttttcaagaggctccattagacaaaagtcatagcagaaaaatctactacagagacttgttctggttctaatatttggagtttaaattccagcctacccactgctggcaaaaagcaaggaggttgtgtctaactctcacttggaggagaaaacaaaaaccaaaggcatcacttgggctgtgctttttccctcactttagctagcatgctacagtcaaaagcagccagggggatccatcaagccaactctcttggagctgtattggtcatctttaaattccgtaggtcacttttacctctcaaaacagctcagctgctgttttataccatggataacttcatagccacccaggcatcacaagtttgttctccacccttttgtccttttcccaaaatgtgattttaccacgtttcagcaaatcagggtcattccagcaattcccatttctgacactagttgtgccagagttccccaagaccaccccaggtttgatgattggctaggagaacttggaagaatcagcatagttccacgcatggctgtgacttattttttctttcttagctttttttttttttttttttttttttcgagatggggtctttctctgtcacccaggttggagtgtagtggcgcgatcttgactcactgcagcctcaactttccaggctcaagcgatcctcctgcctcagcctccagagtagttgggactacaggagtgtgcccccatgccaagctaatttttgtattttttgaagggctgtggtttcaccatgttgccaaggctggtctcaacctcctaagctcaggtgagccaccatgcccggcccatggctatgatttattatagcaggaggaaacatgaaaaaactagcaaatggaggaggtgcatgggactaagttcagaagtaaccaggtgtggatttccaagagtcttcttccagtggagtcacatgggacgagcttaattcctctaccaacacattgtgacaacatgtatgaaatgttgccaggctgggaagttggctagaaactcagtgcccagggtttttactgggggctagatatgtaggcatcccctcccaggcacatacccagattccacactcccacaagaaaagcagatgcttagcataaaccatactgtttgtataaacagtttagacacccatcagttaatggtgggaaccctcctgaaatctaagttctcagatgccagccaagggccacccttataagcaggcctttccaagcacagcagtcagatctgctatgttaacccttttgtgcacaaggaaatcgatgtttagagaggttaagtaacctgcccaaggtgatccagctattaggtggcagtgctaggtctctgtggctccaaagtacagacttttaacccctgaaataaacttgaataaacttgactcttgagtatgggagcctttttagggtaagatccatcctgtgtacaatagaaaagtatgatattgattgcccaggtcatattttaacagaaatgtgttcttcccaactctctgctctactttttccatctgtactctctgtccttctggctgttatactgtaactttctagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtaggtttaaaaccacccacccactcactcctctagactgtgttctgtctgatggtgtgattacttctgtgcttgacctgggctgtctgtttccatcaatctcctgggactgctcaaagcaggaaagggtagatttagttcaaaattttacccaacctttgaaaatcatttaactttttgcaccctcttaagtcttagtaccttggagcaaattcttaatgatgtccttgtcacagcctgccctccagaggacaggagtcagaaggaatgttctaaatatcctctgtcttcctcgttacggatatctgattctgggtcagtcttgcccgtgcatctaagtggaactgaggatctacgtcaacttttacctacaaaagtaatcattaaatattcttttgagatgaagtctttttatgttgcccaggctgaccttgaattcctaggctcaagtaatcctcctgcctcagcctcctgagtagctgggactacaggcacatgttactatgccaagcttaaacatttttgatggcatactggcactatcagtaaattaaatgttgagaaggcacccccaattgtgtctatttatttagaaattacacagtgccatactacttttgttagttattgattgctacttaacaaatcacctcaaaccttggcagcttaaaataacaaatatctattaattcatgggttctttgggtcagaaattcagagtgacttagtggttctggtacaaggtctttcatgaggtgtggtcaagatgttggccagggctgcatcatctgaaagcatggctgggcctcatctgagacggctcattcatggctgttggcaggaggcctcggttcctcactgcatgggcctgtccataaagctgcttgagtatccaaatgatgccacagctggcttccctccaagcaagctatcgggaagctgcagtgtcctttaagtaagtcactaagatcaacccacactcaagaggagaggaattaagcctcacctgtcgaagggaggaatatcaaataatgtcaggacttatttcaaaactacttcattttataatgccatattttcttttcaaatctgttgtggctcttagaagtgcatgttttagactctcggattttactatacagtggattagtgttgaaagggattgatggatgtgagtgtgggggccaattgaggacttgctgcagaaaagtgtgatagggagagaagggagctaacccttgtggagcactttctgcaggctgggcactgatgtctgttcccttctgccaaaggaggtaatgggaagacctacaggactagatggggttgcagacccattataccatgtataccatcaggggccacagctcactgtcttggatgttgtaaccacattttcacccacctgtaatttttttgtagtgattttacatttttatactcttttcagttcctatatgtctaagaccgtaatatggttcagttgttaactctttgaaagacaacaaggagaaggaaatctttgcattttgaggctgattttttttaactggataatgcaaatgtgatgacctcatcctgcctccccgcaaagatgcctgtcatgtgaagcgttatagcttcatatcgatccctctgaaagaaagctgtgcattgttccatctggggtattagtcttataaattgtggaagtagtgccagtcatggactgtggctatcctgtgtcccctacaggtggagaaggtgaagcgggggcaacgaacagcaacttctcttcctgttgtgaacttcgggtcccctctgagaagatgtgagttttctggaggcattcctaagagaccatcttctcctgtgatatccaagtaagcatctctcccctttgccagacagtctgactgtcatgagtcagtttgctagggctttgtgccatccagtgttgcagctcctgctcccccgtgaggcgtggccagccagaagtggtaagtgggagaaatgctggccttggagttacgtggcttgactctctgtgtatcttctgggtgaaagatcctttgctaagggaccccagtgcgtaacagggcttttatttaccaagatgatgcattcagcattttctctttaggtccatgaattccattctgcttttctggtattctttttccagttgcatttggatttaagtgattgcattgggcttgggctcctcctgacattctcccccaccttgttgtctctctctttaatagagagacaataataacttgtcagccatgatcaacagtattttaatgaagcaaatatatatgtgtgtgtgtttttaagaaatggggtcttgttgggttgcccaggcctggagtacagtgactgttcacaggcataatcacagcacgctatagcctccaactcctgggctcaagtgatccccccgcctcagactcccaagtagctgggaccactatgcccatgcaccataacaccaccatgcctaatttttgttaggaactaggtaaactcaccaaggaaaccatgtaactgaaaaatttacaataactttgtgaccaccaaggtcttaagtcattaaaatattttactgacagtaactgacaaaagactcagtaaataactcagtccagtaggacagtggaaaccatctttagtaggacagagaaagaaagagaaatatgatttaatttgggaatataggaaagtttttatatggagagaatcatataaaccttattcagtgtatcagtttagttcagagaatgttggataaacacaagtttaatgaaaacttgcgaatttgtcaaaaatatttaaagatgacatcagctcttaaatttccaatgtgttgctttctaatagagactttttcactactattaataattttttttagagatcactatggttttgatacactactaatacctgccattgatgtgtttgtcctccataaggaaaatctttccatagcacatcactgaattaaaagcctacttttctttctttctttatttttagttcattgcaacctttctgtgctagtattgcccatctttggttatggtgttgttatcctaccacctctttaaatttattatgtggactctacgatccgtttccctctgtcttatatctgagcctttttcagcttccacccatgcatcattactctggtgttaattttggacatttgcattaacagaaagaaaagcctagtttacgctgagacttttacaggctccaccctctctctgtcttgctggaatttggactcatggtccctgcagggatactagcttgcaagtttcatcattattattgtaaatggtagtatcttctatagaaatgagaattataggtatacctagttttgttgtactttgcacttcgcaaatactggttttttttgttgttgttgttgtttgttttacaaattgaaggtttgtggcaaccctgcattgagcatgtctgtcgatgccatttttccaatagtgtgtgctcacttcttgtctctgtgtcacattttggcaattctcaaaatatccaaacttcattattattattatatccattatggtgatctgtgatcaatgatctttgatgttactgttataattgttttggggtgccatgaattgcacccatataagatgacaaacttaatgtgtgtgttctgacagctccactgacaggccattcccccatctccctctccttggatctgtctacaccctgagacagagtaatattgaaatgaggccaattgataacccaacaatggcctcttagtgtccaagtaaaaggaagtgccacagatctctccctttaaatcaaaagctagaaatgattgagctcagtgaggaaggcacatcaaatctgacatgggctgaaggctaggcctctggcaccagttagccaagtcatgaatgcaaaggaaaagttattgaaggaaattaaaagtgctactccagtgaacacacaaaccataagaaagggaaacagcctgtgttagtcagggttctccagagggacagaactaataggatagatgtatatataaaggggagtttattaaggagtattaactcacacgatcacaaggtaaagtcccacaatagaccatctgcaagctgaggagcaaggaagccagtccgagtcccaaaacctcaaaagtagggaagccgacagtgcagcctttagtctgtggtcgaaggtccaagagtccaaaagctgaagaacttagagtccagtgtttgagggcaggaagcacccagcatgggagaagtaggccagaagactaagccagtctagtcgtccttccacactcttccacctgctttttttttttttttttttttttgagatggagtcttgctctgtcaccaggctggagtgcagtggcgcaatctcggctcactgcaacctctgcctcccaggttcaagcgattcccctgcctcagcctcccgagtagctgggattacaggcatgcactaccatgcccagctaattttttatattttagtagagacggggtttcaccacattggccaggatggtctccatctcctgaccttgtgatccgcccaccttggcctcccaaagtgctgggattacaggtgtgagccaccttcacctgcttttatcctagccatgctggcagctgattagatggtacccacccagattgagggtgggtctgcctcttccagtccactgactcaaatgttaatcttcttggcaacaccctcacagacacacccaggaacaatactttgcatccttcaatccaatccagttgaaactcaatattaaccatcacaagtccacctcttgtcgacttgaacccatacacatctcctgagatcatacataatcttcaaataaagacaaataataaggtcgtaattacgcctatccttcctacaactggaagcataccaatccccaacccaaatgctattacataaagttaacacttaaatgctgatatgacatcaataaatcttatgtcacatgataaaggaaagagaaaggaaatgacaatagtttcttcatccaccatgaaggtggataaggcattccatgggtccacagatggtagtcttggcagaagcattgcatgcaggatagacaaacctatatccagagtaagggtatacatgcacaaacatgttcttaacaaaataaggaagaaatactcatgcaattacagtcctcgtttctgcaactggtcctgtgatcgtagctggtactgatgactcccttcttctactacccattctgtattctctttgccttcagcaaacacctcagcaggtcgttgtcttttacctggtggagtgacccaaagtttcactcctgaagggtctgggccatttgtagtcctgccaggattgggctcttgtagttttccattgaccttaatcacagggcatggtaaaactaagagatgccctaagggatctcctgtattccacgcatactctttcttacctccattgtggagtagtaaactgatttcatcttgatagtctgggtcaatcaccccagtcaacactaactgtcttcttagcctgttgagttagaggtaggaggagcttaaagtgtccagggggcaatctttgttgtatctcctggtggcagcattcctccctctggaactaagacctctaggccagcagaacgtaatgttgcgggaacaggaagcaaaaattttgctaatgggtcactaggggtgatggtgagtggtgccacttccatttccaccccttgattcctggacccgtgaatcctggctgtgggagaaacagtaccatgtataggacgttgattcagaacatacacagccttgtgaagaactttgccccagccttgcaaagtattgttacctaattggcattgtaattgtgacttcaaaaggccattccactgttctatcaatccagctgcttcaagataatggggaatatgttaagaccagtgaattccatgagcatgagcccactgctgcacttctttagccgtaaagtgagtgccttgttcagaggcaatgctatgtggaataccatgaaggtggataaggcattccatgggtctacagacagtagtcttggcagaagcattgcgtgcaggatagacaaacctatatccagagtaagtatctattccagcgagtacaaactgctgcccttttcatgatggaagaggtccagtataatcaacctgccaccaagtagttggctgatcaccttgaggaatggtgcatatcgagggctcagagttggtctctgctgctggcagattgggcactcagcagtggccgtagctaggtcagccttggtgagtggaaatctgtgttgctgagcccatgtgtaacctctatccctgccaccgtggccactttgttcatggacccattgtgcaatgacagaggtggctggggaaagaggctgagtggtgtccacagaacgagtcatcctatccacttgattattaaaatcctcctctactgaggtcacccgttggtgagcattcacatgggatacaaatgtcctcagtttttgaccactcagagaggtccatccacatatctcttccccaaatttctttgtcaccaattttccaatcatgcttcttccaagtccctaaccgtccagccaaaccattggctacagcccatgaatcagtatataatcacatatctgaccatttctccttccaagtaaagcgcataaccaggtgcagtgctcggagttgtgcccactgggaagatttcccttcaccactgtccttcaggaatgtcccagaaaggggctgtagtgccgtagctgtccactttcaggtggtgcctgcatatcatccacagccatctgtaaatcaggccctagtcttctcttcctctgtcaactgatcatagggaaccgcccaccaccacccatgaggccatcggtgcgggctgggggagagaaggcagggtgacagggcatttgagccacttcctcatgtaatttgcttgtgccctcaggacctgctcgagcccgatcatgtatataccatttccacttgatgatagaatgctgctgtgcacaccccactttatggctagataggtcagaaagcacccagttcatgataggcagttcagatcacaaggaatggcttccttgctcctcagcttgcagatggcctattgtgggacttcaccttgtggttgtgagtcagtactccttaataaactcccctttatatatacatctatcctattacttctgtccctctagaagtattttggtaccaggagtagttctagaggaacagaatattaaggatggagttctttcgttggttttggggtttctggagttggcttctcagaagcaaggtcacaactggctcactggctctgtgctgcttctttgaagttgaaaatccttttttttttttttttttttttgagatggagtctcacactgtcacccaggctggagtgcagtggtgcgatctcagctcactgcaacctctgcctccagggttcaagtgattctcctgcctcagcctcccaagtagctgggattacaggggtgcgccaccacgcccggctaatttttgtatgtttcgtagagatggggtttcaccatgttggccaggctggtctcgaattcctgacctcgtgatccgcccaccttggcctcccaaagtgctgggattacaggcatgagccaccgcgcctggccgaaaatctttttttaaaaaacttttattttagtttcaggggcacatgtgcaggtttgttctatagatgaattgtgtgtcacaggccaggcgcggtggctcacacctatagtcccagcactttgagaggccaaggtgggtggatcacaaggtcaggtgtttgagaccagcctggccaacatagtgaaaccccgtctctacaaaaaatacaaaaaattagccaggcgtggtggcacgcacctgtaatcccagctactcgggaggctgaggcaggagaatcgcttgaacccgggaggcggaggttgcagtgagctgagatcgcgccacttccagcccaggcaacagtgcaagactccgtctcaaaaaataaaaaataaaataaattgcctgtcacaggggtttggtgtacatattattttgccacccaggtaataagcatagtacccagtgggtagttttttgattctcaccctcctcccacgctccaccctcaagtaggccccaatatctgttgttcccttcttcacgtgcaagtgtactcattgtttagctcccattaataagtgagaatatacagtgtctggttttctgtttctgcattagttcacttagaataatgtgaagtcgaaaatgttgaagaagattgtgtttctagaactattttatacacacacacacacacacacacacacacacacatatatattttttttgagacggagtcttgctctgtcgcccaggctggagtgcaacggtgcaatctcggcccactgcaacctctgcctcccaggttcaagcgattctcctgcctcagcctcccaaatagctgggactactggtgcgcgccaccacacccacctaattttttgtggggtttttttgtttttgtttttgtttttagtagagatggggtttcaccatgttagccaggatggtctcaatctcctgaccttgtgatatgcctgcctcagcctcccaaagtgctgagattacaggtgtgagcaaccacgcctggccaactattttatattttaaaggacacatcatctgagttttgtaaaagctgtccctgatcaaagggacttggttaaaattccagacttttttatgcagtttaatttagagaaaaaaaatttaatttccactctgtctagaacactagtaggcacatagtaggtgctataaatatttgtggaatgaatgaatgcaggtcactatgcccagtgcctcagagaatccccaaatgagtgagaacagtccctatttcaaggaacctccagcaaggtgcggggagccttgtacacagttgagcacagtacaggccctaatccaaagagccgcccatctgctcaggactctgctcagccatcatcctctccatagccagccaaagctgaattcacccccttctctgtgttgacagagcatcatgtgcagccctctttcattcactcacttaacatccagccctcttctaagggctgaggatgcaaaagtccctaccctcctggagcttatgtgacagtgaacagcatggataagatcaggtggcgataagcactatggaaaaaaaattaaaccggttcagatgacagaggggtggaagggagtagctggataaggtggtcaggaaaggattctctgagaaggtgacattatagcagagccatgcaggaaactagggcataggcggggttggtctatgcctcattgcttggtgttagtattttatacttagcaatctcctgctagactgctatgaggttgggaactgtcttgatttattgttgcacagtaggtgctcagtatgtgtgtgtgttagtctgtttggctgctaaactgactggcttataaacaacagagatgtatttctcacagttccggaggctgggaagtccatgatcaaggtatggccagagtcagtgtcaattgagggcccatttcttgattcatgaacaaccatcttctcagtgtgtcctcacatgatggaaggggcgcaagggagctctctggggtctcttttataagggcactgatgccattcaggaggattccaccttcatgacctaatcacctcccaaaggccccacctcctaataccaccaccatggggttagggtttcaactcacatgttttgaggagacagaaacattcagacatagcagtggtatgggatgcaactaagaagggaaggagaagctggggggcaagggcagggtcacctggcagatagggaaaatgttgagaccaaacctgctcaaggactttgccctttgttcactcctgagctcaaatgacccacctgcccctgcctcccaaagtgctcaggttacaggtgcgagccactgcacctggccagttatatcattctgtttttttttttttttttttttttttttggagacagggtctcactctgtcgcccagtctggagtgcagtggctcagtctctgctcacagcaacctttgcctggcaggttcaagcaattttcctgcctcagcctcccaaatagctgggattacaggcatgcaccaccacgtctggctaatttttgtatatttagtagagacagggtttcactatattggccaggccggttttgaactcctgacctcaagtgatccacccgccttggcctcccaaagtgctgtgattacaggtgtgagccaccgcgcccggccatttatatcattctttataccttacaagttttgtaaatattctcttgcatactcattgttggaaaaacataataaaaaagacttacttgatttttagaatgatgccacacacaaaacaaacccccaccaaaactggtatttttgacattccttctgtgcagaccaagtgtgtgatttttaaaacgcactggaaatgatgtggctttgaaaaggggcttaattagccctatgaactcacccatccagaatcccaggcaggtcatgtgattaatgataccttttcctgtgacctcctaagctctgacagtgcattgttctcctgcctgatgtcagataaactaagccactgttgggtggctgtgcatgttaatagcattgctcttttaagcgttcaagtttatttttattgttttcatcattgggtacttgcatgggttttagaaaactagattcaacaacactctgaaagacatagatggagcatagctttgttcccataacctagagaaaagaaatccagtgtggccaagtggatttgtccagcccatctctacctcttgagtgttgatgctgcctgtacttccaggtcttcagtgtgaaatattctctaatggttttatattcttagaaatatattctaagtcagtttggtcattacgataggtaatatttcagctatctattactgctgttacaaagcccccaaaattgagttgcttaaacagtaatttattattcattttcacagttctgtgacttgggcttactgggaggttctctctttggatcttttgtgcagttgctctgtgggttgacttgggttactcagggtcttccatgccattgcagtccagtgttgactggagctgcagttacctagagctcagatgagctgaaggttcaagatgggccattttcctacctggcagttgatgatggctattggctgggagctcagctgagtctgtcaaaccagagtgcctactatggcttctctgtatggcttaggcttctcacagtgactgggttccaacaagaaatggccccaagattgagcatcttttgggtcaggaagcggaagctgtcaggccagtgaaggactatgctctcaattggcacagccttacttgtctgctgtattttataggtcaaagcagtcgggccaacctagattcaatgggatggagagataaactcaaaagataagatcttgtgggatgggagatattattgtggccaactttggaaaattcagtgtgccaaagataatcacttccagaggtagatcatagctgagatcagttttgtttcagggacctagtttaatttcactttatcatgtgttgaaaacaaaacatattccatatgagggaaaaaattaggataaaggtgtctggatggcccaaaacaagtacctcccactttactccaaatcacaggcccgtggaaggctccctcccagacccaggctatccctttggtggctgaggacatttaatggatcctggccaagtgcccttcccataagcttctctgggagatgtgtggcttggttatcctctcccacagataagcatctacagcacactaggctcccacaagggcgacttaactgctgtttttgccaccacatcattctctagtaggcttttacattcttacctgaaattcttcctgaagagggtaattgaaaatgtcaagtgatgtcccctccttgcagccatatctatatactcactcagtcctgtatttttgagtcttatcagaggatcatttgaatttagaccaattttttcagcttttaaatttcgaaatcatttcaaccttgcaaaagaatcacaagactagaacacagaactctttcttccccaccttttatcctgtattaatgtgtagccacatttctgtcatccttcccatcccctatcaccctcactcagtcttgcacagtctctcacattcatcctccatagatgcacacacagacatacatacccagatttctcccagaaccgtttgagagtaacttgcagacatcatacccctttgcccctaagaacgaagacattattttccattgttatggaaatcagaaagtttaacttggtactgttacttaatttctaatgtatgtgcaacttttgccaggtgtcccagtaagattctgggtttttttgagacagactcttgctctgtggcccatgctggagtgccgtgctgtgatctcggcttactgcaacctccgcctcccaggttcaagtgattctcctgcctcagcctcccgagtagctgggattacaggggcacaccaccatacctggctaatttttgtgtttttattagagatggggtttcaccatgttggccaggctggtctcaaactcctgacctcaagtgatctgcctgcctcgccctctcctttgtactgggagtacaggcatgagccaccaggtctggcccaataagattttttatatcattttttttttcatggtccagggtccaacccagggtcccacattgcatttaattgtctcaccttcttagtcttctttcaactgaaacagttcctcagccattctttttcctgaccttgacattattttattttattttattttattttattttattttattttattttatttttcgagatggtgactccctctgtcactgaggctggagtgcagtggtgcaatctcggctcactgcaacctccgcctcccgggttcaagtgattctcctgcctcagcctcccgagtagctgggactacaggcacatgccaccacacccggctaattttttgtatttttagtagagacggggtttcaccatgttagccaggatggtctcgatctcctgacctcgtgatccacccgcctcagcctcccaaagtgctgggattacaggcgtgagccactgcacccggctgaccttgacatttttaaagaatataggctagtcgtcttgaggactgccttcagtttggataggcctgacgtttcctctgattgcattcaggttgtgttctttgggcaggaatctcgtggcagaggtgttgggtccttctcagtacctcttatcaggaggctatgatgtcagtttgtttaattactggtgatattaactttgattactggattaaggtggtgttcccaggtttctccggtataaaactgctgctctttcttatctaggaagtaacaaacttttctgaatgttggctgagctgtgctgatgaagccaagacccctcccatgcagtgagtgggccgtgttcactcactgtgcatggagtcaagtggttttggagaacatggaactagattccaagattggaggaaaaaagtcttttgggggttccactttgcagtcaactcacattcagaggcatgacaaccctctccagagagttattcttgccactgtgtttacagaggtgtttgttcgtattttctgccagtcatggaacctaaaaggttatatcatactgccttatgttcctagaaggtctagtttaccatcctaaacacaccttgtgaatcccctttgttatatttttattggaccttaaaaaattaaagtggaagagctaaaaaagtgagacaatgaacaaatgccttgagtgccagccctggtactcttgtctgtttgcatttctttgggaaaggttgtttaaactcttaggactttggttttcttctgtaaaatatggttaatagcaatttcctacgtacctcactggattactgtggcaatcaaatagacccttgttaaatagatgagaaggtacttcagaataaacctccatacaagcacagtgagttcccctaattaattcatatttcttaaatcagccaaaatacctatttccaggaaattgaaaaatagcttgccagactttctttggctttcagcaatgtgagcagggctggccagagagccgtgcagtctgacataccagccttgtggtttagtttcttccggatacctgtgcttagcacttttgcagggcagctgacagggtacaaagtccatgtaagcaagtggcaaagcaggatgagcaggaaacttgacagattgtagataacattgggaacttcttttttttaattctgtattttgttcactcactgtaaaaaaaaaaaaaatctatgacttgcccacacttttctaatttgaaggtcatgtttgtgtgtgcatacaagtgtgtgtgttttctaacttactctgtttattgggcaggggctggggtcggggactgtaaacagacttcttaatgagctttatcccaaagaatccacccttacttctcaggtagaagttatttttaaatgtgtgctcatgggtaattggtccagttttatttagaatggaacctcgcagtctgtggcgtgaactgaacctacatgtgaccattctcttaaaacaagcaaggctgttcagggctatgccaacttgaggctgtcagaacctcccccacctaggccaccctggccttttctccctaggattaggatcttgtcctgcatttccatttacttagatgggtctgacatagccaacaggctcctgccacactgactgagtgtgtgagccatttaagcagacacagaggttgtgctggaactcagatgctggctatggctgctgaggctgcagccagttcaggcctcccacccactccccccagtccagccctggagacccttgtggtcggagtcatgtctgcaggaaggcttcttgtctgcctacccattcatgggcagaagtgccagcacacttcagggacccccgaagcagagcccaactctttctatactgcttagagaagcccagagtgtgggctcgcaggccagttccagggagagaacaagaacaggcagggttgtgcacacccagcagctttgctcattctcaccaatcagagaaatcgtacctcattccacggggaggagggtgagggcaagcaagaagatcaggtgagatttgccaggccttccaatgccagaaagtcctcctcaacaggtcaaggtaggaatgcttatgggatgagaaagtgtttccatctgttatcatctaccacgagatagtctttcctacagcctctatcgccaagtttcaaatccactccctgcccttgtactgttgttggatcaaaggacacatatcattcacgtgacaatccagtggagagataatgtgctttgatcttggcaaggcactagaccaagtcttttgagacaccctcgtggtggttgggtggcgggtatacagctctactgtgggcgccactcaccttagataacagcgtgaaaggaagacgtggccaagcaaaagaccaccagctgtatctttatacatattaactgagactaaatgcaggctcagctaatgtgtacagttagtacacattgtgtaactcattggaaaaccatgctcaatggagcactgtcagtgtgagcaagcaggacatgggctcccctgttattacagttcatcttcctggttttggttcattcttgtctgtgaggattatttggatttttagtttatcatctaattgatcaacaccaatacctaacagctattgagtgcctactctatgccagttctataaagaacatcttggggtcttggtgaccccaaactcagacttagctgcgctggcaacacaggaagtagagcagagctgtaagaaggctctgtggcttagttcactgtgggaagccatttcacctctctaagcctagttttctcatctgtaaagaggccatgataatagtacctgtgtcataccatttacacacatatgtacacaaatatgtgtctgtagacatttagcagcctagtggctggtgtgtagacagcactcagtaaacatggacacaactgcagagagtgtgaatggaggtctgagctccaaatggccagggtaaggacctggtctgactgtgtcagaacacatgaggactcaacgtgctgaatcgtagaggcactcacacattacctctcaagccaaggctctcaggagcctcaaggtcaccatggggattggacactacccctccaagcagaacagctccactcttacctactgggtacagacagagtgtgtgtgcatctgtctctgtctctgtctgtctctgtctctctctctctctctctctctctctctctctccccccgccttctctctccctctctccctctctttctctctccctctctccctctctttctctctccctctctccctccccgccctaccccatgtctcagggattctcagttgagggagatcttgtccctaaggggacgtttagcaatgtctgaaggcatttttggttgtcataacctgcgtggggagcggactgctgctggcatctagtgaatggaggccagggatgctgctaaacatcccacagtgcccaggacaaccccacaacaaagcactatccagccccaaatgtcagtgatgccaggttgaggaagcctgctctgcgggcgtatatgtatggcggggcagggggattctctgcatggcttttatttggtaaaagtctaggaaaaaatagaagatcagcgttatatagtgtacctggaaaaaaccacctgattgctaagcactctgaaaaaccacatcccttaggagaacccgagtgtggggcctgagcccaaggccagaggggagaatagtctgcagagagtcgaagcaccatccacaaagacaaggtgtcttgggagttctgagttgctccaggcctaatggcatgaggacacagggaagccacttggccaatatgaaagtccacatgccacttgaggattcttttctccttcaagaccaagtttaatattgatctgatcatatttccccttattagcaggatctgatttggtaactctaagcctctggtgaaaaatcgtctttgaatatcagggtgatttgccatttttattgctgtttttatagatcaaaaaagtcagatattagcaattcatggttcaacctgctgaggattgagggtgatgacttgtaatttctgtatacattactttatatccttcctagaggaactctgtacaaatgcccacatccctgttcaaacctctagggaaactgggcatctcaagctaagctgttacccctgtcctgaacaagcagcactcaccaggagcccagcctaggctggcgtacctgtaacggaccctttcccagcagacataagacgagctcctgtgttttaaccaagtggcttgtcctcaccttttgcatctgcccagttgggagaagagagattcttttaaacctgagaccctccaaaaaacaccccccatccccatctcttggctgtgttccttggcatttaaaaagaaatggggaaccttgaagacttgctaagtaaaataagccagacataaaaggacaaatactgtgtcattccatttatacgagtcacctggaagaggcacattcacagagacaggaagtagaagggtgattgccaggggctgaggggaggggaatggagagttgaacgccactgaactgtacacttaaaaatggttaaaatggtaaatttggtgttatatatgttttgtcacaatttttttaaaaggagccagcatgttcattgccatatgctgaaaccagattcaaccctgatgttcacctaaaaagagggagtagggaagtgcctaatactccatctttacattgtcatgaaacctaagtgagattaggacatggcatcatcagctgggcttcttaaaatgtttccctttccaccagggccgtcttagagagaccgtatattcctgttgggctgagagcactttagtgacttttgagtgtgtgctaagccctattttccttcctctggaaggatgaaattgttcagcttgttggaactaggtgtcttaggaacagagagctctgtgttcaggcccagtaatcatcctctggcatattttttgttttccaggacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcaggtagatgctgccaccgtgccttggctttcccaagacggttctcctcagacccaatccacgtgccattctctcatgttttggggagggaaagggatttttctctggggacaagtgcatcccctcgtgcagctttcttgggtttgcacgttgctcctgagttctttccttcagtcttctgagggtcccctggaggaaatctagaggctgactccactcatggctgtggaagctcacggggatgctgagtaaaacaggcctgcatctgcacctcacgcaaaagaagatcttcctttagactttcaggcttctatgatgcagtgagttcacccagatggtggctgctgtggcacttgctagtgaccttgtctttcctcctcatgtttctattgtcttccactgtaaaatgcgtccagggttccagccagcccatgacagcttctcttgcttggtggtcgattgtgctagtctggacggcatttcccatcaccacactgggttggattttttttcacttccaactggcagctgctgtgtgagtggaatcattatattcgtttcccttgatcttttcctcttgatgcctctcctctggtgcagccttggggaagcccacagcaggcaccactgatgcaggagaggctgcgaagatcttggctgaaaagagaagacaggcccggctgcagaaggaacaggaggagcaagaacgactggagaaggaagaacaagataggtatgctagtgctcagaatttcggtgtgatctcatgtaactgttgtgttggaaagagcagcttgcctttctttttacagcgttggtattgataaaacttgaacagaagtatgggaacctagaatgtctgaactacatggaaggtgttcaggagactgagtcttatattagatgtaattattaataacaatggaactttgttcttttcggaggacctggaaactcatagctcttggatctaaatggcacaggcatcttcccattctcctcttggactttggggccaggcaggcctcctagagctatcagggaagtctgaactttgtttaaaaaatgagattctccctgggaaaacaagaggttcaagattctggttttggtcttgattctgatttccaaattgtttcctccgtcaaattatcctaactcacaccccaaagtgagagacagaggggagggttgagcagtgtcccctaggcatagggttgtgtgtaggggcaaccgcatagtctaagaacagtgaggtatggggagtcccatctgggagcaagacaaaagacatcattgcagtggtccctacaccttgaagagcatcagaatcatccggggaatgcagtaaaaacacatggactcagccctgttctgttttagtagcttgccagggtttgagaaccactgtgatgttagtaccagggtactttgtcacaatacagacagaccttccttttctgatctttttatttagagaggaaagcatgttgaaggacaaggtcgattttatcattaaattgataaaggaagccgttaggctcatcacagagtacaatccaatactgtttagagaattatcatgacaggaagcaggcaatgctgtagcacttcaaggccagcaccgaatttagagtaataaataatagaatattattgatcctttagtgaccttggtaagtctttgtggtctctgattacaggtttgctgatctattttttaaaagggacagtggggtaggtctcgacagtcccttcttgaaatttgggacttctttgattgttttcctgtttccaacattttggtcaatacagacgtgttttgtttgtttgtttgtttgttttgtcgagtggcatgtttgggctggtttgggtgggccttaaggtgtgtgaagggaggtcacaagagataaagatgaatcacaggacctcagatgacaggccttgataattgcaggccatggagataccatgtaggctctgagctggtgagtaacatgatcgtagtcgtgtgctaaagaaggtgatgttctttactttccagctaccaccgtctgtatctcccattttcttcacagcccagctcctgaaagacttgattgaacattctgtctttattttctcaactcacattcagtcttcaaacctcacacctaccactcctcctcgttgcctaactactaatcagtttcttggttggctttggccttgtcaagcttgcccttgcttctctggcctctccttcatagcctcctctgtctgcccctcatccccttaaatgttgcctgggctttcagcccttagtcctggaccagcttctctcccaacaagctctcccgaacagcactgctcccgcctgttctgccagtgtccctgccatcctgccagtttcctatggcgtcaaaagatttagggcccacattttacacaacagctttctgttgagcctttgttgtgctaaaccagctctgctctcatctcacttcccaccttcattttccctttgtcttgttttattgtccgtttctgaagctaactgcagcttgctttctaaaccttccatactttctggaacaagggaggcactaataacacatgtgtactgatgactcctaaaactatgcctgtggcccaagctctgtctagggctgcattgtccactatcagaccctctaggcacatgtggccaccaaaatatacattcagtaaaattcatttccccagccacacccgccacatttccgtgctcaagagctgcatctgagtagatgtggatccacaccacattgggcagcacaaatctatagattgttttcctactcaacagaaggttctattggatagcactggtctagaacctagagactgtatttccagctgcaataagttttcgtttgagtgtgtcccatatacatctcaaatccagcatttccaaagcagaacttagtattttttccccaaacttcccttctctttcatgagctctgtgttcccatctcctcagacacccaagtgaaaagtctcagtgctactctcagctctttcctttccttcttcttcccaatggttgtcaggtccagtcttcatcagctgtcacattggcatctctgttctctcccttcccttcccgtccctcctctccttcctcagctccagcccccatcgcttctcacctggactgtatctgttatatcccaactgagctccctgctctaggtctcctagagtttgtcccctgtccacgctgggcccacactgacctttctcaaataaatgtgattgttctcctgtcctttaacaagccagtgactcccctgcccactggatccacccgaacctgtcaacaggccttcaaggcctgccgtgaactgaccactacctgcctcttactccttgctttcctccagacaccagtgtgcaaagctccctgacattcacccatcacacggctccacacctccaaagctgtgcttttactttgcccccacgtggacttgtgctccttcctgccagacacctcttcatttctcaaaatgcaggtcaagtcttgctccctccctgtaccttttctggccctgtgcctgggacagaactgaccaccccccactcttcacccatactgagcccagctgttcagttgactaacatagcttcatttgtttacaggcctcctttccccagttagcaccttaaaaggctgggacatagtctttggatcactggtgcctggcgctcagtaaatgtacaagaaaggaacagaaggaggaagaatcctgactaagaaaccatcgtagtagtaggttaagagaacagaagggctaaagtagtatggtgaaggcagacatgcaaaagccagtctctgtggacttacacaatgccaaagaaatgggcagatttgaagttgatgctgaggtttgattctaaggtcttaggagaatggtacacccaataacaggtaaagaaaggacataaggaattggttttaaaagataaaaattattcatttgattttaggtgaggttatggtgtctacagtacgtccagatgattggagatggaattgaaggttgggggtgtaggtaaaaattagagcaatacactcgaccccaaatgagttttcctctctcttgccagaatgtgaagctttgcatagtgccacgtgggaggtgaggagtgaggaaggaaagtaccagacaacctggggctggaacacagcggccacctcttggaataagatcatcctcacatctgttttatgtttacagttaatagttaaagccacagaaatgttgccagataaaataatttagagaaaaataaagttacttgagtcaaaccgtggaaagcccaattattgtcacaaactggtaagggaaacaccatccaagtcaaggatgggggaaccagaacagaagggccaaccaggagtccagacaagcaggccctaagcagaagaacaaaagttggtccattcccaaacacaacagggcccagcccccaggctgtggatggcccaagatataaagtgagattcttagaggtggggcaggaaaccttagacgccgggtccaccctggggaaggcactggcaggaactagtaagcaggagatcttaatgggattcctagacggatcactttaagtcatgttaaaaagctaaaatagctactaggggttcacatgaaagaatattccagccagacgcaatggcttgtacctgtagtcccagctacttgaaaggctgaggtgggaggatcactagaggccaggagttcgagttgagcctgggcaacgtagagagaccccatctttttaaaaaattgaaggaaagagaatattccagttagacagctccctacgagcaaggtcacgtaggcaggctaaagtttcttgtcgaagcaagagttagcccaggccaggaaccacaggcagaggtcttcgaggctgctcagacctggctttttgctgctgagcctacaggtggcaggtggttttggtgagagctagggcaggtgggggcacatgcgatgtggggcagcaggatgtagcagcagctgaggcaggaagggaaagccaagagaggtaggagagagccagggtcatgcagccttatgtagcacagggctgtagggagagccacatgggcaggacttttgataagacataggcttatcaaagacgaaggctgttggtcttgggatttaggagatgaaaagagattttggagggaaattgttgagaagtaggatagagacaaagcagcctgaagagatgagtggatacaggcccagaatataagctggctgttaagcagtcatgaatgagaagcagctgagagaggactgaggagggttgcttgtgattcccgagacatgagcatttttccagggcatggaaaacatgcatgcagaaggttgaaactgacaaatgaagggaagaggggctagtgggagggacacatagctgtggaggatgtggaattcacagcacaagtggtggcatttccatctaagcagaggaacaaatggggacatttctgagcagtaatgtcatagaggagagtttaagaagctcagatcaggtggcctcagtcttctctgtatagcagttggtgataagcatcaactaaggaagatgacgaagattgagaaaagtggtaattgggactgtgtccataagggatccaggggatgaggattaaaaggccggaatgcaattgccagcaggcagataaccagccagcctcgtttacacctctctctaaccagtgattggcagcccaggagtggtcctggaaaccacccaagcctggagttgggcagcagagtgacctccatgccatctctgaaatgctcacaagggtacctaaggcctggggaacactgagagagagggaagcagacgcaagtagactgcacagcgctaaccagggcaggtcaggagagaaaaaggcagaaggatggggtgtgatcagatcaaagaagattaatgttgaaggttaggcttgttttaaaatgaaaacttttaagcacgtaagaatagagaccagtgaaacccacatactcgtccctcagattgaacaattcaagtttaagtttgtgtcagtgacatgaggaaggttaacagggagcgacagaaaagggggcgaggtgctggagtttccaacagacaggagccaatatatgaagatcctcctcaaatggccagtgacagggacaagggatgatgcatccactgaatgccaaatgatgacagtaatgcacagttttctggtactttgtacatagtgaggaaagggagagggacttgggtgaatgacaagaacaaggatggagagggtgacaggactacacacagggccaggcactggctcacacctgtaatcccagtgctttgggagaatggggtgggcggatcacttgagcccaggagtttgagaccagcctgggcaacaaaatgagacctgtctctattaaaaaaaaattcaaaaatgatccaggcatggtggcactcacccgtggtcctggctacttgggagctgaggtgggaggatcgcttgagcctgagaggttggggctgcagtaagctgtgatggcagcactgcactccaacttgggcaacagcacgaaaccctgcctctacaaagaaaaaaaaaaaaggactacacacagagctgatgaactttggaggtttagtaatgacggcaagggcggtaggctcggggtagcccacggcagagggcggtggggaaaatgatgaaatctaatgtgctgtctggttctttgagcagagacagaaggaatgctcatcctcggagaggattgtgagggacctggtttcacacaggggaagccagggttgtttgttttgttgaattttacctactttagggaagcaaagtgtggttaagggagagaacttggtatataagaggatgaaggggctgggcacagtggctcaaacctgtaatcccagcactttgggaggccaaggcaggcagatcacttgaggtcaggagttcgagaccagcctggccaacatggtgaaaccccatctctactaaaactacaaaaattagctgggcatagcggcgcatgcctgtagtcccggctacttgggaggctgaggcacaagaatcacttgaacccaggaggcagaggttgtagtgagccaagatcacaccactgtactccagcctgggcaacagagtgagactccatctcaaaaaaaaaaaaaaaaaaaaggacaagatttccctggaggtgctatggaaaggacaagcggggtctcatgggcttgtggggatttatattttgggtgataatgaggattatggaggttcaggggccataaggatgttcttacatgtgtgcatctgggcacttctgaagtcctgatggtaaaaaacaagaaacagaggccaagtgcagcggctcatgcctataatcctagcactttgggaggccgaggcaggcagatcacctgaggtcaggagtttgagaccagcctgaccaacatggtgaaaccccgtctctactaaaaatacaaaattagccagacatggtggcgcatacctgtaatcccagctagttgggaggctgaggcaggagaatcacttgcacctgggaggcagaggttgtggtgagccaaggttgcaccattgcactccaacctgggcaacaacagtgaaacgccatcaaaaaaaaaaaaaaaaaaaagagaatggattttcaggtcctggagatgaagacggcaggtcctttatgaagtagcttatacattaattaatacacaatgtatcctttgtgtgttaacttctctgggacaatcataattggctcgttaataaagggtaagaaatgaaatggtacttcagttaacctttagatacatcttgttattaacacatccattttggataatcctgtgttggacatagtatttcattgaggaatctaagaaaatgggagcttctttctgataggttctataatgctcctctccagaatatctgttaataatttgagttgtttcacaatggtttataggcattgtgacctaatttagtgttatcacgtattgttacagtctcaggctaatatatttaagtatttgtttatctttcttttaaaatatttctttgaatgaataaacaaaatatttcctttggtcatacataggctgttagcctgcacaagttctgaagctgaccattaggatggatggatgctctttttaagtcttgacctttttataacaacagcatcccagtaagtcattggcacatgcttccaaatgaaggtaatttctaaaggacatacagatttataggtgcactttaaaggacattggggcttggagagaggattcattttaaattgtaaaacaaactaacgtttgagaaccttctagggccaggcattttcattctcacagtaaagccatagaacaatagtatagcttttcccattttttaaatgggcatcaagaacattgagtgactttccaggtgtcacacagtgagtggcataatcagagtacaatttgagtcatgcccatacatcacattgccagtgattacccaaggaaagtgacgtacatgtgaggaggaggaacattagaaaggttaaaacaagctcttggactttacaggattttcccttactgcttcgagctctttaccattacaccatgaaccattcatctgactgtggatgaaaatgtctaaatgccacttaattttcatatagcaaagaaagctaaaatagatttctaaagattgccaaaataaatggaaatagaggttttaatttattaaatgtcaagtttctgttgagcattttcttccatttgctgcttcataagtcacataccaattagaaccaaattggtatgactttttgagttcgtagtcactgctcttaaattgctgactggcacatttgtggccattgagacacttcccatttttcctagctttcattggttttaaatattctgcttaggttttaaaagaattgtcattcaataagaatgatggcttggctttctgtcaccgtggtcatttgttcattgactgaggagcatctgttttcaatacagtatgcgttacacatcaacacatcattcattgctgtattacagaatttaaagtcaagcctggttaatactttttggtaaatatatggaccagagtggatttccaggaaggatgaatcatgttattaaatgaatgctcgttgaaaggtatgtgtgtgtgttaccatgtggagcattattctcggctgtcagcacacagttctctggcagtttgcttttcgagcatgtcatcttctaacaacagttgtattctcaaaaggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcaggtactgtatgagtcctcagatggactttacttgttttttaaggaccttgatagtaggtacaattagttaaatttcaatgactcataatgtttacttgaagtttcttcttaaactgtctgggctggttattaaatataagttggggcagttgcagtgaagttggtaatgtttgccatctgtgagttagggtttccccaaaggcaaaccctgggctaagaatttgagtgccagcagttttttttgcaagcgaatcccaggaagctggtagaggaataggagaaaagccaatgtaagtgcattgatgcatgtgttactgtgggtgactggaacacagtcccattgggaacctctgacagactgtggatcatgctttagaattgtccagctgagggatgaggaaactgaactacttatctaccacatcctgcccttcacggtagtagaaggtcactccctggggaattaactctctgatctggccacatgcacacttcatggcccaagcctgcccacagacacagaaaagccttggccatgtgtgagaactgtctgcaggtgatttgcatggtgagccaggggtatatgaatgaggtccaaccatgtttgctgtgtcatgcagtggtttgtataaatccacattgaatattggagcagcatccactttagggcagatgatgagatgaaggaacatgtgcaaagccagggaattaccacactgttttcttagcttattaaagctttgccttgatttacctgtttctgttagaaagaagcagcagaaacaaaggcccgggaggtagctgaacagatgcgtctcgagagagaacagattatgctgcagattgagcaggagagactggagagaaagaaggtaagggctgagggtcaggaagacctagggtaagtgaacaggaagtaaatccagttctcttctgcagtgattggatagaatgatcctaggattgtcagttaggtcaagttcattgataccactgttcaaatcttttatgtctttattagttttttgccatctcgttccatcagtgattgagaaagattgttaaaaactccatctgtagcgaggcatggtggctcacacctgtaatcccagcatttagggaggcagaggcgggaggatcacttgagcccagaagttccagaccagcttgagtaatacagtgaaaccctgtctctactaaaaatacaaaaaatagctgggtgtgatggcatgtgtctgtagtcccagctacgtaggaggttgaggtgggaagatgacctgaactcgggaagttaagcctgcagtgagccgagatcatgccactgcagtccagcctggggaacaggagtgagaccctgtcccaaataatagaaaaaagaataactccatctgtgattatggatttgtccatttttcctttcagttctgtcaggttttgttttatatatatttatcgtgatatgcctttgtctctagtgatatttcttgtcttaaagtctactttgacagccccctgccttttatttttttgagacagtctcactctattgcccatgctggagtgcagtggtgtgatctcggctcaccacaacctccacctcccaggttcaagcgattctcctgcctcagcctcccaactagctgggattacaggcgcacaccaccacacctggctaatttttgtatttttagtagagatgggatttcaccatgttggccaggctggtctcgaactcctggactcaagggatcctcctgcctcggccttccaaagtgctgggattatagacgtgagccactgtgcttggcctgacagcccttttatgattagtgtctgtatgtcaaatctttttcacccttctacttaaaacttcttctgtgtgtttttataagtaaagagcatatagccaggaattgttattttaattctgtttgacagtctttgtcttttaattggagtgtttagtccatttacactaactatacttatgggtaaaattgggtttaagcagactgattataaaggagtattctcatggtgtcctaggcccaacctgggctttgtattgctgtaggcctgggatccaggagaccagcctgtggccttctctcctgagatgcacctcagcctcagcctcactttctgtagggtggtgctctttaatggcaggtggtaatttgttgatttatacagagcctaaggagaagaaggagaaatatgggatataaatcgaatattgattctagatacgtactagttaacttctcaagcatttgaccttgtccatggggccggaggtgtacatctccaaaactagtggaaaacctttctatacttgttatcctcttctgacttttgccttttacaagttttctgagaaatgtgacattgcatgtaaaccaagctacttttatgtttttggtcttattgtcctcttacttgattttgttttttgttttttgtttttagagaatagatgaaatcatgaagagaacaaggaaaagtgatgtgtctccacaagtgaaggtaggaattcaaatgaccattttaatagtttatgtactaagtagaaaagaacagcagaatacactcagtgaaattgtaggtcttggcgacgattagccagaaaaaaatgcagttttcctgctttgttcctggctaggttaaggagggttaggtacctgaaaagaaagaggggcttcagaggtgggatgggtaagagatttccttagagtcatgggaggtgggatgaagagagaggcatagtagtccatgaataaaaaagagaatcctgacataaaaatacgtaagaataagggaaacacagctgaagatttaaagaattaccacagaacaggcagatggtccaggctcaaaatatcatcggatgcttttaaaaagtactttttttctgtgtgatgtcagccttccctcatttcattcaccttccatttgttttcagaaagaagaccccaaagtgggggtccagcctgctgtgtgtgtggaaaagaagacaaaactggttgtccccaacaaaatgggtgagtgtgacatctggttcttgggttcttccttttagtagcaaaagctcgtaagacttggtgtagggtaaacagacccatggatcccaagagggtgactgctggcaggggcctgtgcagtttcccttccctgggaatgtgtctccagcacagggactgtcagctccacttgggaacccactgggttccttggttactcccataatcccagcataggaggcactctggctgctggctcacagtgctttccagggagcttaactgctggtcaggttttattactgttaggacctgactctgctcttctccagaggttctgcacagacactgataatgtgatttgtcttctcttctcctgtgtgaaggtgattatatgggtttatttgtggctctttccacaaaagatgctgcagtatcagtgaagcagagcattaaattaattgccttgatctatatttctctgttactttatttagacattttatgattaacacaagggactttgtgttctcgatcagaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgaggtatattcatttcttttgcatttaagcctcatcacttctcgaaacactaccctttcttttagttggtttcttcgtcttttatacaaccaaatcacctaaagcaggtttgattgacattacaggaaagctctcagtggtataacattctagtgtcttgcgtcaggttccctagaagcagagcctggaacagagtttctagggcatgtgatttgttagaggaaagctcttgggagtttttcaggagaaaggggaaggagggaattcgctaagcaaggatgccttctcagctgaccccatgggagctctggaggatgaatttccaccagagacagttcctctgagcttctgcagttctggtttttctagattcttctctaagatctcacaaggaagaaaaagaagaacctggcagcagctttactctggctgttaagagattcctggtgacaggccctcagcccaccactcttcagagcctggatttgttcctttgctaggccttacagctggcgcaattatgaaactcctccttccatctctagggagaggaagagagagagagaaagaaaaccagccttggctgggctggagctggataagtcagagtggattggaagcctcactttagagaggaagcagagcgtgagattggctttgccagtgatgacgtgggctgtggtgggatcctttcattatgggccccccaaccttaactgagcacttcaggcgtttccacatgaactcttctcagcacgatcagattcacactcacaggagccctggcagagagaaacaattgttcccattttactggcgaagaaactgaggctgcaggaaggaaaagcaattcgcccaaggtggcactactagaaaggcagcactgggagccccactgttaattagggttcttcttcaacttgctttgaacttttggcattggctttctgtctgaatgtcccatttagaaagttctggaatgccttgcttctttgtggtagaatgctggtgcctgtgggtttttgtcctttcaccctttgggcaatgtgaccttggccatcacagccctgctcaatctgcttccctgttctcatacatggggcctcgtgtccaccatctgtcctcctcagatttgagcccacttgtattttttacagtgtgttacacaaaaactctgactctaaatccttcttctttagaagagtagtaaaacaaaatattgcaaatagaattaatatattgtgccatgttgtctgtctgtctctttctgcctctctccctctcgttcatctcttctagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtacagtcttttgattatattctaacttcataaccctttaactggggtttgtgaagataggatgtatatcactcagcctcttggatggtcaaattttatttgaaaaacgcaaacatgaatatattatggtatactacaacacacacaagaattgagacagatttcaattaattcatctgcgagccttcagcgccgagccgccttgtcctaaccctgctatttagggtgtgtagatgggaaagttgagaacactggctaaaggtttgactaccagtccagcctgagtagcttttttagggggcaaggaaagaatactctagtagtgttgcaaggtgatatgaataagatgaatttccccacctctagttttgctcagtgacatcccacattctatctagaatcattcatatacagggccacaggatttgctattctcttgacccattctggattcttccaaagcagacagctattcttggatcatacctgagggagagagaactgcagtttttgtgtcttgaaggttttttccccacctttggcctttttttatttttgccaaagtgcttccagaagctattctcatttgagcaagaatgtctatgagttatatacactctgtagtaaggtatacttagttacatatacctcacattttatttacttcagtttggggcttgtttttgaataaggaaaacataattagagtctgtcaccaaatcctttaataatttaataattccaattgctcctcccacttcagattctgtttttgttttcaagagaagtgatctcactctgttgtccaggctggtgtgcagtggcgcaatcacagctcactgagacttcaaactcctgggctcaggagatccccttgcctcagcctcctgagtagttggatcataggcacatgccaccaggcccagctaattttttttagtttttgtagaggttgggtcttgctatgttgcccggctggtcttgaacccctggcctcaagtgatcctctctccttggcctcccaagtacttactgggattacagccatgagctaccatgccttgcatccatttatccattttagattctttttttttttttttttttttttttgagatggaatctcactctgtcacccaggctggagtgcagtggcatgatctccactcacagccacttctacctcccaggttcaagccattctcctgcctcagcctcccgagtagctgggactacaggtgcacgccgccatgcctggctaattttttgtattttagtagagacagggtttcactgtgttgcccaagctggtctcgaactcctgagctcaggtaatctgcctgccttggcttcccaaagtgctaggattacaggcgtgagccaccgcgcccggccattttagattcttaaaagcatttttatattctcggcattttctcagtcactttattttttatacttcactcccataacaaattcactggccaaaataacagtccagtgtttttatttttcaaatgaggaaacaggtgggagaggctacagagctgaggtcactgtgttttttgtatacttgtttctacctgacctcagctcttgcctataagacaagtttgagagcccatttctcttggttcttggtgtgtggtgggtcacttttagagtaaactgtatcactggtttggaaaagcagctgccttcttggacacttaaaacactaaatcacctgagcattctatttccctgacagttacgtggcttaatatttattaagaggttttttgtgtttttaacatactttgactttaaaattagtttcccttcagttcacttacctcactatacagtaaggaacagagaatccacaaaatttattagagtattcataggtcctcaaatttatttcttacatctctaaaagaaatgcaaaacccctgtccaaaaagaaaaatctcaaattattttattcacactgcttgtatatttttaattatgattgggtctagttctcaaattcttctctaccaaaagtggtaccacccccaccaggagacgtttggacatacgttgatggtttttgttgccagagtggctgggggcatttgaaagacaaagcttgagacattaaatatctgcaggttttagaaaagttccatacaaggaaaatttgacccatctaaaagaatagtcctatgtaaaatactctatcacttctgttgagaaatactgtataagcccaggaggaaaatataattgccaagaaggtagaaagtgccacagtgtgttgtgatcgttttagtgagagaatagtgctacaaactgcacaatacttggttttccctttgatctcatctggttttgtttctgaattgacacaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgatatgtaccttgtgtttaatgtgaaatacattttcattgaagagtctgatgacttgctagcgttttattttttctgtaagctcaatgtgctgaaaccaaaccaggcttttaaaaacctgtgtagaagaaaaccaaaaaatcctgtgtgggtgtcctttccctgtcaaactcattaaaaattcctttgttgccagtgc

SEQ ID NO: 3282 - DNA, 108582 bp, human
gcgcctgtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggtattatccccagagtgtggcgggcgcccgagggcttcgggttcctgtgggggggcgggcccggcggcccagggcaaaggtcctcgagcgtggggggaaggggcacggcgcagagctgagataaacgccctttccctggcccaggatcgtccggacgtgcatccaagggccgcacccctctctgtgcgagtggcggggttctttcttggggcgacctgggtgagtgggtacacatggggggtggcttagggtgggcggcaggtgtgtttgggatggaggtgcctgagggggtgctgcgggtccagtccccgtcctcgaggagcagccggcatgggggtcgttaggataaaccgagcggggttctggggttgccccggcctccgcgcgcgctctctctgcgttctgggaaacgcgcgcgagcgccgctgcagcccgcggcgaaggtggcccagcttcgcgcctcttggcgtttccagggggcaaaatcggcgtgtcacccattggcagaggcagattcgcccgggcggccaggcgtctgccccggaccgggtgctcctcccgcccggatgcgctccctgtcttgggaacgctgctcaggtggccgggccgcggccctcaatcgaggcagcggggcaaacaaggctctcagccctcgaggctgccgatgctgggagccatggagggctggtccctggctgcccagaagccagcgaggcagcggaggagactgtgaggacatttggcaggattttagataagcaggtctgatgctaacgttctgtaaagtggttgcaggtagtgcgggggtgtaagcagcatggaaaccgatttcatgctgtttttcctgacaacaacttttttatttttagttaataaggcaggctatttttaaaacattttttattgcagtctaatatgcatttaaaaaaccacacaaaactataattcgatgaattatcacatagtgaagatgggagtattttatatacgatgggccaagaaaaggaaagaaatcaagagaaatcttcttaaaacacgctttttcactggggttgagggggcgaggtagtattttctgactgggccttcagttgcatcattcttaggaggaggagatagcttaaatcatttccagtttgtatttttcattatgctattttaaaggcagaattcattaactgtcacaggataacgttataactacctttgaaatgtgtgcttttgtttttatcctttttgcttgaaacactcaagctgcatctgctagggaagaacctggaaactacccaccagaacgaccctccgtggcagaggcgaccttgtataataaaacactgaaaaggagaggttgtttcagtttgcatttttatttggttgagagcttaaataatagtttgtttcgatgttctgttgtactcatgagaggtggggaggggcggtatgattgggttttcagtgtatcttggattttatttgaaggaacttaaggggtttttttttttttttttttaatggaaacaaaattggggaaggggaggaggtacttttgcgggggagattcttaataagttctgtttggaaactattgtagaatcatttaatgcactcttctgatattaagattagcttaaggatatcttccttcatttgaaattggaaatatagaaaaatatgtgtgaaggtttaaaatgtgaaataagcacctatgtgcattaaggttggtatggtaaaattggaatgtttaatttaggtgccaggtgataccaccatttgttgtttgggggagttagcaaggccaggtacttaagtaaagtctccttagaaaaattatgattttgaggttttataattatctgtcctggatactgatcattcttggttacccaggcccttagcatttgggacccattcctaatgagacttaacctgcttttctagagagtcaaccattgttcctaagcttgggctgggtgctgtcaaggctgcaaaatacagaaagacctgagatgtttaggctgtccaacaattttgtgttgcacacttaggggatatgagttggcaagtggttttcctgggagctgtgtaaaagacggaaaggaaataccgctggtggtttcctctagcaacaggttcttccgatattgaaatcctgtgcatgttcccattaccccctagtgatgccttctttctttccttttaattacctctgaatagaaattaccagatctactgtccattttagtgcttgtctgatacacatagtataacaaatgagcaagtgcttgtttcaatctgcttaacaacctttaaccagcagatagaatcaccagatctcaaccatatttcctttctttctttttagatgaagtctcactctgttgtccatgctggagtgcagtggcacaatcttagctcactgcaacttctgcgccaccatgcccaggatcccagcactttgggaggccgaggcaggtggatcacttgaggtcaggagtttgagaccagtctggctaacatggtgaaaccctatctctactaaaaatacgaacattagccgggcctggtggcgcatgcttgtaatcgtagctacttgggaggctgaggcataggatcgcttgaacccaggaagcggaggttgcagtgagctgacctcgcgccactgtactccagcctgggtgacagagcgagactccgtctcgaaagaaaaacaaaatagggtggggcctggagatagagagtaggtggttattggagactgcgaagggtactggggggtgggaaggaggtaggaatggttaatgggtataaaaaaatagaatgaattaataaggcctggtatttgatagcacaacagggtaattatagtcaataataatttaattgttcatttaaaaataactactagtatgactggattgtttgtaacacaaaggataaatgcttgagggggatggctaacctgttttgcatgatatgattatttcatattgcatgcctgtaccaaaacatctcatgtaccccagaaatatatgcacctactacctactatgtagccacaaaaattaaaaattgtaaaataaaaaaaaaagtagagtgggcccgagtagcaaaggcattgggtccccaagaaatcggagttcttcatcctttttcaaagttgtgtttaaaaccattcttgaacgctttaatcctaaaactgttcagatcgctgggcgtggtggctcacgcctgtaatcccagcactttgggaggccgaggcgggcggatcacgaggtcaggagttcaagaccaggccggccaagatggtgaaaccctgtctctactaaaaatacaaaaattagccaggtatggtggcaggcacctgtaatcccagctactcgggaggctgaggcagggaattgcttgaacccgggaggcggaggttgcagtgagcagagattgagccactgcactccaccccgggcgacagagtgagactccgatcttaaaaaaaaaagtgttcagatcaagaagaacaagagaacaagttgagtttgtgcctctagagtctctttggtagtaggaaggaccacaaacttcctacaaagttgtatttggtttgtggctcctggctttttttactgatggcagcataggacttagacttagcaggaccttcaggacaaactgctgaaagtctttgtgatttctcttctcatatcctagccatggtgacatagctgctcaaagtctgtcatttctaacctgcttcctctccaacatgaaaggatgttttcctctcaggtgccccatcttctgcagtggctagtgttttaaaagaacactttgtcttcttgtaattacattgattgccttacaaaacagaaggattcacaaggttgatttgggcaggcgagagatggagatttctgggggctgttggtaaatatcctggtgggtcttgttgagaggatttgatgagatatattggctggtgatacaatgatactgcctggttttagggggctgttcatgtgctaagttggctcaggcggcagttccaagatttgaaaacttcccatggccctgccctccggtcccttttgaaaggaatttcaccagaagaaggaagagggggtagtagagggcagccgcccttagggagggagtgtccactgtccacctcacatctgagtcggccgcatttaaatatggagtttaccgtcttggcatctgaggctctgggtctgactaggccttgggatcccgcctcgtctgcctctgaggtcagtctgaatgcaagcccccatctgcttttctgttgggaagcatttgttttcctcttgcctaggaactttttctgtttttaaaagccttgtgactagcagagtttgggttgtcatttaagcgaaaggaaaacaggtatgagtgagccgcatgcatgcaaagcatttgaggcaacagcagtgatgccaaatgcctgagatccttggaatgacagggtctgtccccagggctcctagcttctgaccagtgctgggttcgttcaccacctaaaaagacttggcttttcctctcagtgccaaataggttggtgccttgtagcccccaggcaaccctttggaatgttccttgctcctttgtcatctcacccgcttcatccgtcccaccctctgtgtttctgtaataacagctttatggctggtcgtggtggttcacacctgtaatcctagcacttcaggaggctgaggcccacagatcgcttgcactcaggagttcaagaccagcctgggcaacatggcaaaaccctgtctccacaaaaaatacgaaaaattagctgggcgtgatggcacgtacctgtagtcccagctactttaggggctgaggcgggaagattgcttaagcccatgaggtcgaggctgcagtgaactgagattgtgccactgcactccagcctgggtgacaaagtgagagcctgactcaaaaataaaaataaacagctttatcatctgtataaaattcatatgccatatagtccacccatttaaaatgcacaattcgatggtttttagtatattcacagagttgtgcagccatcaccacaatcaattttagaacatgttcaccaccccacaaagaatccccatactcactgacattcttcattcccccggcctcacaactacccatctgtctatatagagaccacgagacttctgccgggacagtcttcagcctttggtgcagacacgcgttgcaattgcctagaagtctgtgggtgggtcttcatgcattagaggtttagaaaccaatattctgcatactctgtccttcaggtctaagacgcgcttttaccctgaagccttgccttttcacctcctgtacattcccactccacagggcctgcaaagcgctcagaacctgaatgtaatgtacacagcggtctgcagttatatactgcacatgttcattttagcttcccagacagtaatggccgctaattgttgagcacttatgtgccaaccctcatagttctgggggttgcctgggcttattggagaagttctgctgctccatttggggtcacctggagtccctcatgctggtacagtctgctggtctgctgggagctcagttgggctcgaaatgtccaagatggtctctcattgtccaggtacctaatcacagagagtctgtcctggactttctaacagcgtggctgctgtgctttgaataaggaagcagaagttgccagttctcttaaggcctgcacatagaagtcccagaatgtcatttttgctgtgttcagtggtcaaagcaagtcccaaggccagcctagattcaaggggagaggaaatagactccacctgttgatgtgagggcagcatgcacctactgggaaatgagaaattgttagtggcccttttggagaatatctactgtaataggcaagtacagtcgttccttggtatccatgggggatttgttccagcacctctcaagaacaccaaaaatcaaggatgcccaagtccctgatataaaatggtatagtatttgcgtgtaacctatgcacatcctcccttatactttttttttttttttttttttgagacagagtctcactttgtcacccaggctggagtacagtggcacgatctcagctcactgcagccttgacctcccaggttcaagcaatcctcccacctcaacccctccaaggagctgggactataggcatatacctctatgtctggctcatttttgtttttgttttggtttttttgagacagagtcttgctctgtcacccaggctggagtgcagtggtgcgatctctgctctctgcaacctcgcttcctgggttcaagtgattctcctgcctcatcctcccaagtagctgggactacaggcatgcactagcacgctcggctaattttttgtatttttagtagagatcgggtttcaccacgttggccaggctggtcttgaactcctgacctcaagtgatctgcccacctcagcctcccaaagtgctgggattacaggcgtgaaccaccgtgcccctccctcccttacactttaaatcatctctgggttactgataataaatgtaaatgctatgcaaatagttgctatactgtgtcgttgttttgggaataatgaccaaaaaaaaaaaaaaagtctgtgcaaccatccactttattttatctgaatatctgaatcttttctttttttttaagatggagtctcaccctcttgcccaggctggagtgcagtggtgcaatctcggctcactgcaaccactgcctcctgggttcaagtgattctcctgccttagcctcccaagtagctgagattacaggcctctgccaccacaaccggctaatttttgtatttttagtagagtcggggtttcaccatgttggccaggctggtctcgaactcctgacctcaggtgatccgcctcccaaagtgctgggattacaggcatgagccaccacgcccagccttaatctgaatatttttagtctgtggttggttgaatccttggatatgcaacccttgaatacagtgggctgattatatgttttaattaagaaaggttatgtattcagcgagaggtgagagattaaaaaaagaagaaaggttaagttatttgcccaagggcacacagtaagtggcaaaccaggcttcacacccaagtgtgtttgacttcggagctgagaaacttttttttttttttttttttttttgagacggagtcttgctctgttgcccaggctggagtgcagtggcatgatcttggctcactgcaacctccgcctcctgggttcaagcgattctcctgcctcagcctcccgagtagctgggactacaggcgtgcaccaccatgcccggctaatttttgtacttttagtaaagatggggttttaccatgttgtccgggctggtctcgaactcctgaccttatgatccacctgccttggcctcccaaagtgctgggattataggcgtgagccaccatgactgacccagagctgagaatttttaaccccccgtgccactgtgcctccacggatggataataaactcctttcgcgcatgagctgtgtctcccacatctgctatacccctctgaggatctagctcagtactatctagccacatcttacaaagatcttgtatgccttttacttagtacacagttgtttttctccccaaaggcgatggggatctcatttcttagaattacagcaaaaatgttattaaaatgcttagaggaagataagttccatttaatggaatttcctagtttaccaggaatgaaccccccatcctctctgtgcccacaattattgttaaggatctgaagatacccttaatcggcttcctgccttaggacactgtgttgggtatgattgaggttcttgctgttaactgtggtcattgctctagaaggaccctggaagattctctgatactctaggctagtgtgtctcaaactaactctggtaaaggagcagtttttagtttttttgtttttttttttttgtaaatttccaatctgctgttgaccagtatcttggtaaaacacagtaaagaaaaatatatgaaagacatggaaaatacaagtcccaatttttaaatatcaggttagattaatattagatttaaagagctcattaagtaacagaatactctgtccagttgctgtaaatgttctaaatgcatgccctcggtggggtgcagtggctcacacctgtaatcccagcactttgggaggctaaggcaggcagatgacttgaggtcaggagttcaagaccagcctgggcaatatggcgaaaccccgcctctactaaaaatacaaaaattagccagatgtggtggcgcatacctgtagtcccagttactcgggaagcggcggcacgagaatcgcttgaaccagggaggtggaggttgcagtgagctgaaatggcgccactgcactccagcctaggtgacagagtgagactctgtctcaaaaaaaaaaaaataaaataaaaaagaagcatgctctcaatttatgcctttattctttattgcagattgataatgaataataaagagattgtgctccctccccacagcccatcagggttaggctgctcagggtttcctgaagaaaaaaacaaacaaacaaaaaaaacgtaaaaaagagagactggcacctgtccacaggacacactttgaatagctctgccctgggccagtatttcccaaagggtatggtacataagagggttttagattgcatgtggacagacttatctttttaactttagattaatagttctgttgattcttcaatttattttaaaactacaactagtacatcatgctacagtttctgaatattttcagaatgagtaaaaagtgaaaaaactacaaaaactaagcgaaaataagtcaatttaaagaaaaagactatccactgggcctggcgtctaggaaaaaaattttaaaaataaaaagaccaaataatagaagtcagtgctggctaatacaaacagaatgctagccacatatgtaatcttaatttttctagtagacacattaagaaaaagaaacggtgaaattaatataatacaacttacttagtcaagtatgttccaaaatattatctttcagcatgtaattaattaattaattttggggggggcgggaaacagagtctctctctatcccccaggctggagtgcggtggcgtgatcttggctcactgcaacctctacctccccggttcaaacggttcttatgccttagcctcccaagtagctgggattataggcacatgccaccacgcctagctaatttttgtatttttagtagagacagggtttcaccatgttgtctaggctggtcttgaactcctgacctcaagtgatctgcctgccttggcctcccaaagtgctgggattacaggtttgagccaccgcgcccagccccttcatcctcttatgtaccaagttctctcccttaaccacactttccttccctaaagtaggtaaaatttggcaaaacaaccaaccaatcctggcttcccctgtgtgaaaccaggtccctcacaatcctctccaaggatgagcattccttctgtctctgctgaaagaaccagacagcacattagatttcatcattttccccaccgccctctgctgtgggctaccccgagcctaccgcccttgccgtcattactaaacctccaaagttcatcagctctgtgtgtagtcctttttttttttttctttgtagaggcagggtttcgcgctgttgcccaggttggagtgcagtgctgccatcacagctcactgcagccccaacctctcaggctcaagcgatcctcccacctcagctcccaagtagccaggaccacaggtgagtgccaccatgcctggatcatttttgaattttttttttaaatagagacaggtctcatgctgggattacaggcatgagccacctcacctagcctcagcatgtaattaatattaaacgttattaatgagatatctgacattcttttctttgcagcaagtctttgaaattccatgtctattttacacttctagtgtgtctccatttggactgtttgcgtttcacgtgctcaatagccaactgcggctagtggctactgtattgtacggcactgacctagagcatttccatcacgcagggagttttgtggtctacattgagtctcatggtgactaagtattcagtgtgatgactgtgctgtcaagtatggcgtgaagcacagtatgtgtgctgtggtagtgagtccagcttggatctcttcttcatgaatgtagaggaaatggaaacacactttgatggaatgggctcccccatatcaggcaaagcaggcccggattccccaggcttttgaagggatatcctgattttgctttccccagcctgggtgaagggagtgcaccaaggctgtgactagtgggtcctcacacagattattgtcttggggacctgatagactgtggaaaggggatggacttggctttgtgggaattattaagctgtcatcgaggaaaagtgctaaggtttgaatgtccattccaaaactcatgtcaaaattgccattgtgatggcattaagagatgggacctttaagaagtgagtaggccatggggctctgccctcatgagtggattattgttgatagtggattcggtttggcccccatttgctctctctgtatcatgggcttgcttgcccttttgccatgttttgatgcaagaagaaggccctcaccagatgccaagcagatgctgacaccaccagcatccagaattgtgagccaagtaaatttgtttgttataagttacccagtctgtggtattctgttatagccactgaaaacagactaagacagaaagcatggtattgaaaaaacatggaaccataactgtgggaggagagagctgtattagccagcttaggatctcctgggtttggtgttggggtcggggtcaggaatccctgctgctgggtagggtctgctgagtcgggattcaatgggctctgtgagattcgatctggtcatcttccccagctggtgtcatgtcttcctagtgccttgtccacagaagccacttgctgattctgaccaataggtactgattgactgttaggacagatgccctaactctgggaactacaccattaaacagggaagttccagtgtatctgggctggttctgcctccatctttctaggtttgatgtgaaagagctgccattagttacagatggccttagtggactgattacccagcacctgcttcagggcctgcaggatgaaccccttcccagaccagcttgtctccttcctgagcagttggtctgtcttcaccgttggtcactgattccttcagagttgactcttggtttagcaactcaaccagtgtggtactctggttgctgtggtagatgtatgggattaacgtccttttcagctccattttttatccctacccttgtttttctctttctctcctactttctgtatttatttctactgtattttatataagcaatcttaatcttttctggaaggagggagggagggcaggaaatgacctcgcagctggagtctcaccaggcacctgcagccctttattaagcagtgctctatgtccctgtttcagaacaacaccttaatatgtgctattaacttgaagtaaccgtctgaatcgtaaactgggcaaaaccgaattctgctgatgtgcttattcttaaaaacagccccccatgggattcctgtatgttctcttccttcaatacctagcgcgttttcagcactacatttaccagagggaaagtgtattgttcatggggatagcatcacctcttagcaggtgttgctcttttctaccctattaattgtatttgtttagttttcttgatcaccagtcaggggtgacagtgggtggtgaaatactgtgacagccttcagtggaagctttccttgtacctgggtaatttttcccctggtggagatacgtgttatgaataaaatttagcattgatcattttcattagctagataatcaatatttttaagcagttgtagttatgtctacagaccaaaagctcttttaaaaaaatcactaattctaggccaggcgtggtggctcatgcctgtaatcccagcactttgggaggccgagaggggtggatcacctgaggtcaggagttcgagaccagcctggccaacatggcgaaaccccctctctactaaaaatacaaaaattagccgggtgtggtggcgcacgcctgtaaccccatctactcgggaggctgaggcaggagaattgcttgaacctgggaggcagaggttgcagtgagctgagattgtgccactgtactccagcctgggctacatagcgagactctgtctcaaaaacatcataaactaaacattaaaaattatgcattttaattgccattttcttactgcaaaacatgttcctgctctccctttttcctctcctcacccacctaaatttccacttcacttgattttacttttgccagtcacaaatttttttctgaagaataattgcttcttattaatagtccattgagctccacatatccctaatcttctgggatgagattaaccctttttatagaagaacaattaagtgaggaaaatggactgtttcactataccctgttcaactttaatttctcttagttgtgttttagtttctctgtttcaaccaagaggcccaagggttctcagtgcctttctactggggagtgttgaatgtcctttgtggtacatagttttatctttactgcttaaaaatcaaaaggattatttacactttggcatgtaaagattatatcagagcaaatggctcttaattcaagcagagataagacatgcaaggtacaacactgtccagtagaactttctgtgatgttggaaatgttctaggtctgaactgttccatatgatggccactagccacatgtggctgttgagcattgaagacctgagtttttaattgtttctaaatttaaaaaaattgaatttatatcagcacatatagtagtagcttctgtattggactgtacaattaactagctgttgactaacctcgacagattaggatcaggaatgaggaaggagtttcagatctcaaacaaagttacttcaaacccacctactcttggtttctcctgtacaggctttgatatttggcacttgtcattcaaccactctcagatgctggtaggccaccaagaacagaaccagcagttagctccttgacactgtatcaggtctgtaggacagtgatcgaactggtagacaagacttgttcctggctccgtggtggccctggagtgcccacagtcagccaatcctctctgtcctgtctcagcttttcaacttggcacaactgaagagtaaaaactggagccagggtctttagtttcacaacttggttggagaaaccagattgacttacaagccattaccaaaccattagataaaaccagtagctagctatgcaggatttgggtgagctgtgggcagagcttttccagcaaaaggttggcagggacctcaaccacaccctaggccagagaaccccgtggcaggaagtgaggttggtgggggcattggatgcctttgctgagttaatcgtgttccctgttctctagcaagtactcagtaaaatggataagtctcagctctttcattctagcttgctccttacaaactgcggcctcagacattggcccctagaactcagttgcttgtctgtacaatgagattgtacacaaggtgatcttactggtgcgttccaactctgtgatgctgtgatcctccacagctggcctaggaagcagagggaagcatatggctgctatctacccttctcattagtgggatcaccagccacatagcttagaacgactcccccccaccccgcccattacagccaaacccgagggttctgccttctttatctctcatgaccgcatccccatggccagtgctttgggtcagactctgtcatctagagcctcaccagtatcagaagaaccttagggatctctgtccgtccgtccaggtcaccgtccctgtcatggatccttcatgtcattctcttgctttaatctcctctgacacttgcctagcacttcttaaagagtatattctaaactgctgttggagttttcaggcatgttggaatggggctccaatttacccctccacccccatctctctggcctgtaaccactcccgctcagaatgttcagcacactttgcacgtgactgcttgtgtacatgctgttctcttcacctggaattcttttcctctctgtgtctgccatcttcattcctgtctaccctgttcatctttcagtacttggctcacacctcacctcctctctgaagccttccccaaccacacacacttttgatggttttttcccttcttattcattttccattacagcattgattatgaaaatgcagataaaccatgtgcaaataaaactgggactggcacttggaaactaaagtacacaaatcttaagtgcacagtctgattatgtatacaaccatgtaacccacacccagatcaagatgttaaatactttcagtacccagaaggctccttcatgcctcctcctagtcaatacttctctcaaaggtaaccactgttctcacctcttttcactatagatttgctttgcttatttttaaattgtattaaaatagattcatttaggagatacttttttattgtgataaaatatatgtaacataaaatttactgttttagcaattttgaagtgtacagttcagtggcattaagtacattcatgttgttgtgcagccaccaccacaatccatctccagaactttttcatcaagtatatccttctttgtgtctctttttgttttcttttcacttgacattatgtctgcaagattcacctatgttgtcacaggtaccagtggttcatttctttttatttctgagtagtagtactttgtgtgactgtatcacaatttgttttatcaattctcttgctggatggacattgtttttttccagctttttattcttttgactaaaacttttatgagcgttatgcttgtgcagataccttgatgcccatacatttctgttgggtacatacctagaagtggaatgggatctgaaatgtcacttcatagattctatataaagagtgtttgtaacctcctgaatcaaaacacaagttccattctgcgagataaaatgatacatcacaaagcattttcacagttagcttgtttctagtttttatcgcttgatattcgattttttcttataggcctcaatgggctcagaaatgtcacctcgtagattctacaaaaagagtgtttccaacatggtaaatcaaaacacaggttccattctgtgataggataggcatgtcttcagcattagcggatattgccaaaccattttccaaagtggcttgtattcatttcttattgctgctataacagattatcacaaactttagtggcttaaagcaaaataaatgtattatctcaattccagacgtcagaagtcttaaaatcaaggtgtcagcagagcctttcaggatgtgctaagggagaatctgtttccttgtcctttccaacttctttttttgtttgtttgtttttttttttttttgagacggagttttactcttgttgcccaggctggagtgcagtggtgcgatctcggctcaccgcaacctccgcctcccgggatcaagcgattctcctgcctcagcctcctgagtggttggaattacaggcattcaccaccacacccagctaattttatatttttagtagagacagggtttctccatgttggtcaggctggtctcgaactcccgacctcaggtgatctgcctgtctcagcctcccaaagtgctgggattacagacttgagccaccacgcccggttgtcttttccagcttctagaggctgcctgcattccttggctcatggccccttcctccgtcttcaaggccagcatcatagcatcttccaatctctttctctcttgctccttcccctccctcccccccagctctacttccactgttacatctcttctctctaactcacctacctctgttgtgattaccttgggcctacttggaaaatcctggataatctccccatctcaagagccttaacttgatcacatctagaaaggtctttttgttatatgggatagcatattcacaggttctgggagctagaacatcgacagcttggggccaatattttgccagccacatggctgtaccattttgtattcccaccacagtgcatgagagttctagttcctctccatctttgtcagtacttggtatggtcagtcttttgaattgtagctatactggtggagatgtaggggcaagtccaaggctgccaccccaggcagtgcatcctcctttgctccagtgatagctttattgcaacttataagcattatattatgaatatgtatttacattcctctgtcttagccaaactaagcaccacttcatgagcaggctatatagtagttgatttaataaaaggtccttggatgcgaagaactgactgagggcagttttcagcagagcagggaagcagagctgaagatataaatgaaagcccatgcttccagtctcaactctgctcagcccccaggatctgagggaagtaggatttccctcaaataaaaataggagtagagcaaagaacctggcttccaccttctgcacactgttgtctttcccaagatagttaatctataagtgagtaatgccctagaaggaaatttgggccttgactcctatgggtgttggttggaaatgacttcactgtatatgtaaatgagaggaaaatacagttccagctggctactggggagtctgatcttggaccctttgcagggactcaggttttccttttccttggactctgctcatgtagcaacatactgcagcttcttacttacagaaggaaagactccaaggtaagtaatgctttcttgatctcagggaatgtctgtcatgtgtgtagacttaaacccaccttggaaacttgaggttggaatgtctgcagaaagtgaagccagagtagagatgaatttccaatgcccctggacacaggatggtgggcacagatgtcttcgtactagaaaagaatctcggaaggtgggattagtattagataaaaggcagacaggatgatggcttctttcgggagcatcctgatgcaaataagcactttctgggttctgtttcattccctagtttactttgctgggcacacacctggtttcatgagggctgtaaggtttctaggcttcattcttacctttctaggctgccgaggtgttagcagcattcctgcagcttggcattgctgtgacctgagagagagagagagagagagagagagagagagagagtataaacttgcagtgtggcagaggacttccttggccctcacaaggtcaaccaaaacctggctggttggtatttggatcaaaagggagtcggtctttgaagaaaagcattatctcaggataggaggtactgtgacaggcctgtgccagagttattggtccctgtttaaaaatgtactgacagtgtcacagctttagtaatttaataagtacatgtgtggttcacaggctgatctgaaacaagctggctgtgccagagtgggtcacacctggaccttgagtagtgtggatggcacacacaccatgagggttgggacagcctgaaccaaactgtggccgtgtgtttatggagtgctgctgacttcttagacatccacttatctctgcctgctgtgtttgagatgtggaaaatgtcaggtggcagcattcatgctgagaactgtccccctgggatttggactccctctttactcgctgccatccaggtctggaggtgatctcgagaaagaatatggggtgagctgtcctctgtaatcagatgggtgttcactttttccaggacaggcactggatctccgctcaacattctctggggctggaggggtacccttcacctcctgggtcaggaagctctttatgttgatagaaacatgtctcctcttgctacccgctcccccccccaccgtgtagagagcggacaaccccttggcatccttttcacagaacttctaagtctccataaatgtggggaccaagagcctttctgtggcctacaccacttccagttgtttaaaccctcctggtgtaactttttatttggagtttactcctgtgacattggtgtctctcttctctaactgtttgcacaaattgtccatagtgagccctttcatctcagttaagaatttcccacttaatctgatcacctactggcttggccactaactagctataggacctggccacaggttagtttcttggcctcttctttacctgtgaaatgggaacatatctgaaatacttcatggggttgacaggaggattgtgaagtgttgcatggaaagtgtttgtagtgcagtgtcttgcacagaggtagtactctgttaagtaggaggggagcttatcatccgtgtagccagtacgaggacctaggctggatgtctgtggacataaaaaagattttttgttatagtgtacacttatatcaatatagtcatattgatatatttatgtatggtctttgccttccagggaactagtaacctagtgagataggttgtctctaacttactgtaatccaagttgagcattgataagtaccataaatgaaaatagaaaaatggaccataaggctatagatgaacagttcattctggctgagagctggggtcagtttttgtgcatttatgagtcccaaaggcaagtgatttttttgggagggacagtcacttatactttggtggcccatggttagcaggacagcacttcccacctggaagtggcctctatctttggccacgttcttcagtttctgcatagaaatgacatttctttttctcccacctagtgcttaatttatgattgaaattcttgaagtatccagtgatgccctattcaggaggctgtccagccagtagcattcctttttattcgttgcctaatgcaacactgacagtagcgttcatttttctcttcctataagtatgtcaaagtctcttatcctaggtcctagttctcactgtcctaggtgagctttctcttcccactttgtgcagttagtatttttccacagacatagaagaagaaaagagcactcttgttttttggccccacccctctttggcacacactacttaggtgcttcaccccacacattggcccagagcttaagagaaggtcatctgactgtctggagctgtggaaactgcacatggcttttggcaagagaatcttgtggtgtgctataagtttttaagtttaagagtttacactctgcactggataatatggtaactaattccatgtgtggctacttaattaaaattaaataaaagtaacaattcagtttcttgattgcactaagccacatttcaagtgctccatagcccagttggatggcacagatatagaacacttctgtcattgcaaaaaattccatgggacagtgccggtctagggggttgccttatagttgtaggctactaataggaaagatagatgttcattcaggcttcagtggtttagattttcctcctgaatgacccaagttgaatgtctaagctttaaatctcatcaactaatgcaattaaaatattttaaccttcttaaatttgaatacaaaaagggtattcattttctgaagtcttttttgtgctgccgaattaccctgaagtagatagcaagtgtggattcttacaggtgaggaccttaatttgttttttattgtggtagaatatacataacataaaattcaccactttaaccattttaagtgtacaatttagtggcattaaatacattcacaatgttgtgtaaccattatcactatctgttttcagaactttctccatcatcccaaatacaacatatacccactaaataataacttccctttccacctccccccagtctactttctgtctccctgcatttgcctattctaggtacctcatataagtggaatcataaaaaatttatccaatgtactgactcatttcacttagcataatatcctcaaggttcattcgtgttgtatgtataagtagtatgtgtcagaatttcttttttttctttttttttttttttttttgagacaaggtcttgctctgtctcggagactggagtgcagtgatgtgatcatagttcactgcaacctcgaactcctgagctcaagtgatcctcccacctcagcctccccagtagctaggactattggcgtgcaccactgtgcctggctaattaaaaaaaaaaaaaaaaaaaggacagggtctccctatgttgcccaggctgatcttaactcctgaccttaagcaatcctcttgtcttagcctcccaaattgttgggattacaggtatgagccactgcacccagccagaatttcttttcttttcttttctttttttcttttttcctttttttttttttttttttttttttgaggaagagtcttgctctgttgcccaggctggagtgcagtggcacaatcttggcttacagcaacctccgtctcccggtatcaagtgattctcctgcctcggcctcccaagtagctgggattacaggtgcccaccaccatgcctggctaatttttttgtatttttagtagagatggggctttgccatgttggtcaggctggtcttggactcctgacctcaggtgatccacctgcctcagcctcccaaagtgctgagattacaggcgtgagcctctgcacccagacttcttttctttttaaggccaaataatatttctttgcatagatataccacattttgtttatccattcttttgttagtagacattggggttgcttcccccttttggctattgtgaataatgctgctgtgaacataggtgtgcatacatctatttgagtccctgcttcaattcttttggatatatacccaaaagtggaattactggatcatatagaaatgctatgtttgaccctgttttgtgccaggggagaagtggggagacagggtgggtcttgctctgttccccaggctgaagtgaactggtgcagtcgtagctcactgtagcctcacattcctgggcttaagttatcctcccacctcagcctccaaagtagctggaaaaacagtcacttgtcaccatactcagctaatttttaaattttttgtagagatgtggtctcactatgttgccaaggttggtctcgaattcctggcctcaaatgatcttcctgcctccacctcccaaagtgccgtgattacagacatgagccactgtgtgtggccttggccctgattgaaaaacaaacaaacaaacaaacaaacaaacaaaaccttaaaatcattgttgagatataactcacaataacataaatttcattcttgtaaagtgtacatacagcccagtcgttttaaatatattcacgaggtcatgcgatcatctccactagtcactgattttttttttttttagacagagtctcactctgttgcccaggctggaatgcagtggtatgatcttggctcactgcactgcctgggaaaacaggcgtgagctactgtgcccggcctagtcactgatttttatagcctcttaggactaaagggagagggagaatctagaaagtggcttgggtgcaaggaagggagctttcaggattatgtataatactcttaaaacaggatatttgttaatcctagcactttgcgaggccgaggcaagcagatcagttgaggtcaggagtttgagaccagcctggccaacatggtgaaatcccatctctactaaagatagaaaaattagctgggtgtggtggcacatgcctgtaatctcagctacttgggaggttgaggcaggagaattgcttgaacccaggaggcagaggttgcagtgagccaagatcgtgccactgcactccatcctgggcgacagagcaagactgtcaaaaaatatatatatatatacatatatatgtatatatatatatatatatatatatacatatatatatatatatatatatatacatatatatatatatatatatatatatatgtatgtattttttttattaccaattccttgaaacgtctcataatctttagcaacaatcctctgcccactgcgaggctttctgacctgaagtttagaaaggctcccctgctacctgacatattttcagctactcgtgaggccttgttttatggaacgggatgttgaagaacctcacaaatgggtcagactccccagcaatgctctggaagcctgcttctataggagcagacaggtgttcatgtgctataagctttgtcacatgcccttccctagcagggaactacttctgttccttctctggttctggtcctaaattctgaagctacttgcatttccaaacataaagcaagttgtttataataaatgccttaaatatttgattttcagattcatattgctctgctttggaacaaggaatacaactcctctgcttttgttattacaagccatttatacatataccagggtgctctggttttcacttgttctcatcctttagttgtggttttaatattttgtgctttggacatggttttattgtggttttcagatacatggccagttttcttttctttctttttttaatacgtcatacaattcacccctttaaagcgttcagttcagtggatttagcatattaagtcatgcaaccatcaccacaatcaattccagaatattttcatcaccacaaaaagaaatcccttacttgttttaccccaaccccctgccctaggccacccaactactaatctcagtctctatagatttttgaccagcgttcttgcattcttgtttaatggttattttttatttttatttttatttttttttgagatggagtctcactctgtcacccaggctggagtgcagtggcgcgatcatggctcgctacaacctctgcctcccgggttcaagcgattctcctgcctcagcctcctgagtagctccgactacaggtgcgtgccaccacgccaaactaatttttgtatttttagtagagacggggtttcaccatgttgaccaggcttgtcttggactcctgacctcaggtagtccttctgcctcagcctcccaaagtgctgggattacaggcgtgagccaccgcgcccaggctaatggtgactttcttcctctctaaattataatataagccaccacccttttttccgtctctgttccatttttgtcttttccccttccctccctcccctcttctgatattagcaggttagctctaaattctccttaattagctcccaaaccggatgaattggtggatgtggcacaactgcaggaattcatccaacaaaccagggatggacaaatagtgtgtttgagccctcgaacacccttccaagtcatctgccttcattctgtcactatgaggccagccttcttttcactggctgggaggctgtgggaactgcgagctaggccagcaagagagaactgggtggaagctggtctcagattgatcagtcacacagcctggggagcaatgaactgagatttcagtgtgtggcccatgtgagtgagtactgggacagaaatcaaatgcttgccttacaaatgtagtgtccagatgtataaattcagccactggatcctcctatcaacagaaacatttaatagtcaaattacagtttcaaaatcagtttacaaattacagtctgaaaatatcagtatttaacttgagaagcactgttactcgtacctggtacagagtcagaactcagtgaaacttcccctttgccctctgaagttttgctgaaaagtgaactcacaaaagacagattaattagagaaaaggcatacacattttattcacgtttatacagggagaaccatgagtgactacctacctccaacagggttcagaggctttatataccatcctggcaaaataagttataagacgggggaagaagaggaattctgttgagaggatcactagggagaataagtggacaagataacttgtatactatcttgtgaacgggtctttcaggtgtggttacattcctggtcttacaaggaggggaagaaaaaaataaatgttccttttggtgggtctggactttaggcacataaaggaacttcaacttcgtcctgctttgggagagacattggtagggggaggagggggaaggtcagagagaccttgaggcttcttcagttcagtacgtcaaagtgccatattttgggatatctgcttctgagccccaacactgttattaagaggccatattttattgtaagcctactgtatacaaggcacaggttaggttttgtgaaaaataagccaaagcttcttgaatggaattcaagccctatttatgttataatgtgcaggagtttagcaggttaacactggggaagcagagacttggtagcatccacattttgcttgtttctttagaaccatatattttattaaataaatttttataaaacaatgtgttaactgtagataccctcaacacaggaaaggtttggttaagcttagattcttgctgggaattgtagatattataatttcttgtggataatttaaaaaatttatcatttactattggccactggtagctttattcaaggcaaaccatcttgctcaaaacaaataaccttgaccaaaaaggtagccaggatcctatttagtctatctacagattgtttttggttaaaaagacatcagtgtttgttccatgccatatatgtatctcctgtttcattacatctccgtattgctgggaatgaaacgagtaccagcaggcccttgctgtggaattttctgagcgaggtcagagagaagcacagtgtacttttagaacaagatctgtcctgcctttttttgtattctggagtacacttggggagaaatagagtaagctgctgtttggggaagaagtttgggcttttgatttattttgaaggagtttaagaaatgctaccaccatgcctggctaatttttgtatttttagttgagaagagatttcaccatgttggccaggctggtcttgaacttatgacctcaggtgatccacccatctcggcctcccaaagtgctgggattacaggcgtgagccaccacacccagccaatactagttttttttattgctaaagagtgttctgggccgggcacggtggctcactcctacaatcccagcactttgggaggcagagacaggtggatcacctgaagtcaggagtttgagaccagcctggccaacatggtgaaaccccatctctagtaaaaatacaaaaattagctgggcatggtggtggccgcctgtaatcccagctactctggaggctgaggcaggagaatcgcttgaacctgggaggtggaggttgtagtgagctgagatcgcgccactgcactccagcctgggcaacaagagcaagactccatttccaaaaaaaaaaaaaaaagagtgttccactcacagtgaatataccacagtgtttttgctccattgctgttttatccattctttctttcttttttttttgtctaagatgaggtctcactctgtcacccagactggagtgccgtggctctacctgggctcattgtaatcttcgcctcccaggctcaagcagtcccacctcagccttctgagtagctgggaccatagtcacgtgccaccatgcctggctaagttttatccattctcttgctgatggatagttggactatttccggctttgagcaataatggataaagatgctgtgaacatgcatgtgcaaaccaccttgtggtcctgtgtttgctttatttctcttgggtaaatccctcagggcgggattgctgggtcatatgtatgttttaactgtggaaagaactgccaaatcttttcccaagtggttgtattcttttacaccctcacctgaagtgtatgaaagttctaactgctttgcacctttgccagtacttgctatagtcaatttttttgtgggatttaaattttttttgccattccagtatgtgtataatggtatgggtttctcattggttttaccttgcatttccctgatgattaaagatgttcaatattttttcatgtgttgattaccatgtgaagtgtttgttcacatttttttttttttttttttttttgagacagagtctcactctgtcgcccaggctggagtgcagacagggtttcgctatgttggccaggctggtctcgaactcctgacctcgtgatttgcttgccttggcctcccaaaagttctggaattacatgcgtgagccaccatgcccggccggattcggcaactaatttgtacatcttaaagctcctacaagtttatgacacattattatatggcagaaatagactaaaaataactttctgtgcaaaaatagttctggaagtcgtgtcacagggctcttggcccagcagggagccacttttaactagagctaaaagccagcattgtaaatagcatagaattgactgtaaagaggcaaaagggaatgttttgggatgatggaagtgttctaaaacttgattatgggggtagctgcaaggctatataaattcacagtggtcacttaaaatgggtgaactttacagtatgtaagttacacctcaagaaaactatagtaggaagaaagggagaagggggaacgagggaggagaggaaaggaaaaggaatagaaaagcaagcacaaatataggagggcattgttttgtaaaaacccatttcagctacagaaatatgtacattgtaaatatgtatttctaattgtggagttattaatgatctaaaacgttggaaagctcctgctccaagggaatgacatctagggcagtgctttgcaaacttgatgggaatcccctggggatcttcttataatgcatttcatattcaataggtctggggcagggactcagagtccacattttgaacaagtttcagctcatgctgacattgctggtctgtggacctcacttctgagtagcaaggactagggcataaattgaggctgagctattgagaatacacaaacttaatactgtcattgttggaagggtctttagaaaaatctagtacaatatttcccaaatggacatcatcatgagaaccttctaggggtacttattaaaaacacagattcctataatcaagacagtgtgatactggcataaggatagacaaacatatcaatagaagagactgcagagtccatatatgagtaattgaatatttgacaaaggtatcaagataatttaatggaaaaagaacagtcttttcagcaaatggtgctggaacaactgaatatccatatgcaaaaaatgacccgtgattgataccttgcatcatatataaaaattaactccaaaatagagctaaacctaaagccataaaacttctagaagaaaatacaggagaggccgagcacggtggctcacacctgtaaccctagcactgggagaccaaggcgggcaaatcacttgaggtcaggagttcgagaccagcctggccaacatggtgaaaccctgtctctactgaaaatacaaaaattagccagaaattgcttgaacccgagaggtggaggttgcagtgagccgagatcgtgccactgcactccagcctgggcaacagagcgagactctgcctcaaaaaaaaagaaagaaaagagaacacaggagaaaaccttcatcaccttgggataggcaaggacttcttagaacacaagaagctcaaattataaaagaaaaaaattgataaatcaaaccatcaaaaattaaatcttcttttcttcaaaagacaccattaaaattaaaaggcaaataagatgaggagaaaatattcacaataaaaatgtcagacaaagaactgtgtccaggctgggtgtggtaactcacacctgtaatcccaacactttgggaggctgaggtgggaggattgcttgagcccgggagtttgagaccagccagggcaagatggtaggaccctgtctctgcaaaaaaaaaaaaaaaaaaaaaaaaaaaaaaaaaaaaactgaaaattagctgggtgtggtggggtacacctgtagtcccagttaccagggaggctgagccagtaggatcccttgagcccaggaatttcaggtgacagtgagctatgatgatgtcatggcacactccagcctgggacacagagcgagactccgtctcaaaaaaaaaaaaaaagaaaactattgaccaaccttcttgtgaataaaatataagcaaataaaaacatcttgcagctcagcaagtaaccccaaaaatgtgcagatgtgaacagaggctgggcacagctcacacctgtaatcccagcactttgggaggccaatgcaggcagatcacttgaggtcagaagttcgaggccagcctggccaacatggtaaaaccctgtctctacaaaaaaatacaaaaaaaaaaaaaaattagccggacgtgatggtatgcacctgtaatcccaactattcaggaggctgaggcaggagaattgcgtgaacctgggaggcagaggttgcagtgacccgagatagcgccattgcactccagtccagtgacagtgtgagactccgtctcaaaaaaaaaaaaaaaaaaaaaaaaaaaaagaaaagaaattagttgctggatccataagttaaaagaattttgaccttcttaaactccccagttgacttgtgacatgtttttaagcctggacctgctatttgcttgtgtgttagaccatgatggttagcagagaggtaaaatgattttaaatattttactaagtaatagtcacatgtgtctgaaatactgtaatttctgaaaataaggctagatttgtgaagttttattgccaagacaggctctgaaaatctttccttaaatgaattagaagcccagagttgaatatgttgttttagtctgtttgtgttgctataaaataatgcccgaggctgggtaatttataaagagaagaggtttatttggctcatgattctgcagactgcaagaagcatctgcttctagtgagggcctcaggctacttccactcatggtggaaggggaaggggagttagcatgtgcacagaccacatgcagagatagaggaagagagagggaggaaaggcatgtgctgggctcttttttacatccagctctggagggactctcatgggaactaacagagcaagaactctcattaccacgagcatagcaccaaaccctcatgacccaaactcctcccacctggctttaccaccaatcttggggatgaaatgtcaacgtcagttatccagactatagcatatgtgttacaggtttctgttgtgaagtgaaatatattttcctttgtaaatcatgcctttaagacaaggccttgcctttcacctctaggcaactgtcactccccccaccaatgtgttattctggagtcagactgcctgagtttgcaatgcacctctgccacttaaccagttctgtgacctcaggaaagtgtcttaatgtctcagtttccccacctggaaaatgggtacaataatagtacttactgcatagatttgttaggataatcaaataagtgtagacatgtaaagtatttagggaggctgaggcaggagaattgcttgaacccaggaggcggaggttgcagtgagctgagatagcgccactgcactccagcctgggcaacagagcgagactgtctcagaaaaaaacaaaacaaaacaaaacaaaaaaacagcatttaggactgtgcccgacatgatcaatgttgattattatcatcatcattattattgctatcctcattatcattatttctctaaactggctgttgtcgaaatctcttattaagctattttccatgcctcccaaattctttaacaactaaacttatggcttttcccccaagtctcctgaggctgcttcctatttctgcacatttccgcatacgatgccaaccactgttctcctggcttcctgggccgaaaacttcagatctcctttgactctctcctccccacctccattcagttgcctatatgtgtagtgtctaccttttcatactagaattatcctttcctttccattcagattctaatcacctctcatctggattattcatttatcgtgtagctgaaatgggaccgtgtagctgaaatgggaccgtgtagctgaaatgggaggacagggttcccgtgggcccagccctggacccacctgtgtgggataggggacaggagcagctgggaagacaggattgggtgcgggacatggacatcagcagtgtgagggacaggataaggaaaggacagtgagaaggcggctctgagaaggaccggccacaccttagggcctgcctgtatttgaaatgcctttattagcttttgcatattcctcacagacatctctttgcatacaatgaaggtctttgggtgaattggatgaaatggcttgttaccagcttgaatgatcacttagaaaaaaactgcgcaggcctgcacggtggctcacacctgtaatcccagcactttgggaggctgaggcaggtggatcacttgaggtcaggagttcgagaccagcctggccaacatggtgaaaccccatgtctactaaaaatagaaaaattagctgggcatgttggcggatgcctgtaatcccagctacttgggaggctgaggcaggagaatcacttgaacctgggaggtggaggttgcagtgagccaagattgcaccactgcactccatcctgggcagcagagtgaggctttgtcacaaaaaaagaaaaaagaaaaaaacttgagaaaacattttaccctgttccttctctttatctttgtttcttacatttagtgaccatattggctatgtattgtgtgcatacaaccatcacgccctgtccttagcagagaactccaattttgaaacctcagaaggtggatactgtgctcgatgaaagtactcagtgccatattgatgagcggaatgttgggttaccttgggaacacagacgtccttccttgttactataaaaagggccacagtggctgtggttgtaaggcaacctacattttactgattctttatggtaaaaacgtgcctgtagggaaatgctgtatttttttaagaactttgatcagatacatcagacttccttttagtgctgatcaaatcaggtaaacccagttttcagtacttacgggtttttacaagtatcaaagctgtttccatccatccttcttctcctctttcctgtgcccacagtaagtaggcaggatatttgttgtaagactcaatatgaattgttttcaccaacagggattatgactaagagtataatttatactaatgtccttaggaggggacttatttgcctggtagggcctgtataggtcatatgaaggcagatggcgtgtgtttgacctcctcagggtggcctgttgagcagggttgcctggccaagtaagccttcccactccagattgtgaggcagctcaatgtgtttgcctcgcttgcaggttcctaccatggtttcactgtactgccatctgggaaaggaaggttggtgcagtttattccataataattaaaagccttaccactactaataaggcgtttagatacagccctactggccgggtgtggtagcttacacctgtaatcccagcactttgagaggctgaggcaggtagatagatcacttgaggtcaggagttcgagaccagcctggccaacatgtcaaaaccccatctctattaaaaattcaaaaattagctgggcgtggtggtgcgcacctgtaatcccagctactcgataggctgaggcaggagaattgcttgaaccagggaggcggaggttgcagtgagccgagattgtgccagtgcactccagcctgggcagtagagtgagactctgtctcaaaaagaaagaaagagagagagagagggagggagggagggaacaggaaggaagggagggagggtacagtcctacctaggggaacaaattatgcccattgatgctgtcaaacacctatcagaagtttactaattctctgcgattgaagaattattttattattgctaccatttttaacaaagccacccaaatgggaatcgtgtttattttctttatcgttttctgaggttttatattactaccgtatattgatgtggcatgaaccaaggtgtatacactgtgaagaaggtttttttattcgtcacatgcagtgtagcttactacagcaggcttccttacccttggcactactcacttttggggctggatgattctttttttttttttttttgtgagtcttgctctgttgaccaggcgggggtgcagcgatgcggtctcagctcactggaacctccgcctcccgggttcaagtgattctcctgcctcacactcccgagtagctgggattacaggcgcgtgtcaccacacctggctaatttttgtatttttggtagagacagagtttcaccatgttggccaggctggtctcgtacccctgacctcaagtgatccactcgtctcagcctcccaaagtgttgggattacaggcctgagccaagggctggatgattcttgtttgaggctgagggttgtcctgtgcactgtagaatgtttagcagcatccctgacctgtacccactagatgccagtagcacctccccaggagatattttggagtctcaaaatatctccagactttgccaagcactggggtacacagtctcccctggttgagaaccacagtattagaatgtaaggattgtgtagcttgctatttttaaaggcagtggtcatctgaagcactagttttcggtcagctataatagaaatgtatgtattgacctttaagtatgacagtttggctaacttaaaataatgtggtaaatccaaaacccgattgctgtgatgtgctagcatgcttaaatagcaacagcatattgctgttctttgatgatcgtttttacagatgaatggcaacacacaggatttgaaaatgcatatatcatttatttttatgttcctgaaatgaaaaggaaagaaatagtgacagccacaacagcccaggtaccatccatactcaggcatacctgtagtgcacatgggaaaagcacttttcctatgtgttattttggaatggcagtggccttttctgtggaatggccaaaagagaagcttgtacatgtccataaaccttgggaattctcccctgaaggcctcgttgttttacttttcacaaatctttcccagaaccaaatattcagttccacggtttaccttttcttttgtatcataatctgtagttttactattttcaaaatcaacttttaactactggcagcaataaattgaactttaagattcatggttcttttgttttccaaagagggttttagcagggatgcggttagaggctggaggtgggttagatagaggtaaatttaattgacaagctagagataactgcgaggctgtttaaaaggccaaccagactgccctgaacaatgttgaatgcggttacacattgtactctgcttttgtggtttaaaaataatctatctgtggccgggcgcagtggctcacgcctgtaatcccagcactttgggaggccaaggtgggcagatcacaaggtcaggagttcgagaccagtctggtcaatataatgaaaccccgtctctactaaaaatacaaaacattagccgggtgtggtggtgtgcacctgtaatcccagctacttgggaggctgaggcaggagaatggcatgaacccaggaggcggaggttgcagtgagccgagatcgcgccattgcactgcagccccgacaacagtgcgagactccgtctcaaaaaaaatacaaaaataataatctatttgtgccatgaagctgtttcctcaaggcctcaaagtgcccttgaagattgtccttgtttaagaattatgttgtggctggactgaggatgccagacgcacagatctgtaggcctaggatgggggtaactctgctgggcatgtttttcagagacaaatggaaatggaacaggggttctaactttcaaaatcatttttaacctgtctcccaattgttgtaataccaagagttttactctctaattaaaaaaatattttttgtagagacagggtcttggtatgttgcccaggctggtcttgaactcctggcctcaaacgatgctcccactttcttcctaagcactgggaatacaggcatgagccactgctcccagcccaaaagagtgattttttttcctagcccctttatttatcctttgcattttgttttaaaactaaggaatcttcttgaaacggaagccagctggtggtaggagcaggcctaagcactaccctgatgacttgcattgctcttcagtagccttgtcagtggcctctggactcagtggtgtaactgggaccatctcttctgtgggctggaattgccatgagctaagttggaatagcagggctaggagagcaagcagttcacattgggtagtttgtgctcagcagtgattaaagctcagatctgggccgggcgcggtgggttatgcctgtaatcccagtactttgggagtctgaggcgggctgatcacctaaggtcagaagtttgagaccagcctggccaacatggtgaaacttcgcctctactaaaaatacaaaaagctgagcgtggtggtgcacacctgtaatcccagctactcaggaggctgaagcacaagaatcccttgatcccaggaggcagaggttacagtgagctaggatcgtgccactgcattccagcctaggcgaccgagtgagactctgtctcaaaaaaaaaaaaaaaatcagatctgatgcccagtgagatggccaaggaagagttgtcagcctaggaagaaggggctgtcctcagggaaggggtctgaagggtcctgttaaccctgtaacagtgaggttggagggaccccaaacaaccacatacatgtaattgtgcagaaacagaaacaaggaatgaggacaatataatcagcttgagacaaagagcttgcagttggcttgctcatactcaagagtgcagcttgtcctatggtagggacctggggccttatgggcatctgggccaggagtgccatggagattggctggaaaggtctctggtgagcctttgggatccttttttctttctttttctttttagctatctccctataggaaggatgagactcttttacatcttttactttcatgttattaaacacacatacacatcaccatgaatagaaatcaaatgacattgctaatactggaaactccacaggtaatttctctttaccagtcattacctgctgggttctgtccacagtttaaaagagatatttgtacatttcttgtgctttgttgctgagaaaaagcaacaagcttctaagcaagagtcatttatccccgtgtcttggccctctttccagaagctcaaagcctttctgagtcttgtcttggattggtgagttgggagcttgtattttcacatgacacaaccctcattgagcaaccgcttctcctgatatgtaacctgaaagccagcctctgccccaccattacaggaaaatactggctgggttaggctgaggaataatgatgcctgacatttattgagcagtgcttgtgtagcgcatagtgtactgagcagttccctcttttccctcctcctgtttgcatcctttccctctcaattaatgctcctagtgatccagtgagtgggcgcgatctccatggggttagaacccaggctacctggctctggagcccctgctcccagggcactgtactcagctgccctctctgtacttgctgggggatgtgggggtgctcttcaagggtcattttgtctgcatgattggagccctttatcaggtgagactccagaagctcacgcaaaagccctgcatgtcagagcctctccatctctaaaggacctgaggccaagttcagatgcccagacctacatgccctgtccatggtagaaaactctacccttgctgccctgtccatgtttactgccttatctcattctagccccatttgcttgttggttttttgggatcaccttgtatagggtgggtagaatccacattcttgttgttgaagaacaggcatgcacaaaaaactgtgatgaacagaattacacagaaaggagagcatgaaggtggaggagagatgatcttgcaaccaccgcacagggaagaaggctgggaggacagacctcagcatagagtcacccgtattaccttagggagccctgagcttagctgtataggtttcttttaactagcaaatcatgctgtgaatagaatatgctgtgcatattggcttattttgaaattacatataattgtagaaacacaggaagctaggtaattcctgcctcccagatgaggatccagggtgggagctaagctttcatatcatggtgcccggtagataatcagttgagtttaatttttctagactatgtcttccttcgctacctttgagtttgctcatcttagcttctaagcaaactatcagcttggcagagaaagccttagaatgaaaactgtgacctcttaggaagttgtggggggtttcctggagtagttttatggggttcttgggaagactgaaatgattccaggatttggggcccagtggtcatctgccccaacttgttttgtctgtgttctcttctatcatcaggggaaaggagccaactgtgaatactcctgcatgccaagcattttcaaaaggtcttgcctctaccccataaccttgggatgtaggtagtaatgttcctattttatagaagaggaatttaaacctctgagatgttaaggaatttacccagtctcttgactaggatacagttgggcaggccacatggatggagccaagaagaagctctcagggccgagggggctgagctttatctatgaatggggagaaaatccaattgaggcagttttactgtagctgtagaaagaaccaggcctttggggcatttgtagctgggatctgatgtagactggagacagttaaaagcatgagaaagtcaggttaacagttaccctggaagataacagctgtcaaggaagagttcaggaccaacgaaccagcttcttagatttccttatcttctggtaaccagcaaggttaggcctttttgccatgctctttctcttcagccactgcctgggcctttgcaggtgacttcagttcccatgctggccctggcagaaggcatacctcctatttcccatgctgcccttggagtccaaatacaccccacttcttcacagggccacagtgaagatgtggttacctgggagttgccgggttattcttcatagctttgggcactaacaacatatggcaggtggtcagcactgaattttgccttttctgtttgttgctgtagttgttacagctttgaaaataggtataaattacatacactacaatgcacaaattttaagtctactgtttgatgagttttggcaaatatgtacactctcggggcctagcctacccaatgggtcccccactggaggcttggggcaagctgaagacattgctgatgtgaaaacaaggattaaagatcagggagggtcaggggctggttctagactgtggtagtagacatggtggtggtcaggtaatgagattaaggaatactcatgctttctggatactcaggacatatctcatttcagggccatatctaaaccagtaataatgatgataatactgttagctaatatttattaggcatttaatatgttctaagagctttgcatatattgttccttaagctccacattactctgtaacacaggtgctgtttaacagctgagaaaagtgaggctgagaagcttccccagaagtcacacttagtgtgtgctgagcagggatttaactgagctgggcagagcccactcctctttcttagcatcatccttcgtgcttcccagtaggaatagctaccattttctagatatctaggtctctctgtcagtgctccttccctttaggccctctcattattgagagtcaaccagactggcctcaaattcatgctttgctacttaatagctgtgtgactttggacagatttcttaacctctctgagtctcaatttcctcatctataaaatgggggtgcctcccacctcctaggagtattgtgagcattaaataatatttgtagagaataatgcctggccagaagtaggtgcttaggaactcatatttttagaaaaagacaatctagcccacaaatacgtgtacagtcctcaaaactaggcactgttgaattttataacttggcatgttgtcttttggttctggggagcttatttaccagattgagttactggcgcaggagttcctggggtggctgagtacatgtgtatgaatatagaataacatcatcatataccaccttcataattagtgtttgtgagatgtcatctctacgtactttttaaataagaaattacttattttgctgaagacaggatctctcatttctaccataaagggcgtgtgtctacatgtgtagacaaaaacaagcaaacaaacagtgattggtaactgatatactctttgcagaagatgagaaatgaagaggacatatacatgtttctagtataatttttgttggaaaagaatccttgccctagttttacactggcagtgttgtaatgtactctatcttatcacccccattaggaaaggtagcctgattgaggtttccaggtgtgtgtgcagaggccctccatagtggaaggtggagaacaataaataggagcatgtgcattagaatagccaacgcagaatagctggatttgttgagctcctattgtgtgctggatacagttaagcagtgcctatatctcatttaattctcactctatgataggttctactcttatctccattttatagaagaggaagcttagagcaggtcctgcggaactttcctgttttttttgttgttgtcgttgttgtttttttagacagagtcttattctgatgcccagggtggagtgcaatggtgcaactttggctcacggcaacctccacctcccaggttcaagcaattctcgtgcctcagcctctcgagtagctggtactatgtttatgccaccacacctggctaatttttatatttttagtagagacggggttttgccatgttagccaggctggtctcaaactcctgacctcaggtgatctgcccacctcggcctcccaaagtgctgggattacaggcgtgagtcactgtgcgcggctagaactcctgttgtaccttcttctgataaccgtgtgtagaggattttgtggcagaatggtgatgattacatgccaagttttggagtcgggggtcaggggagggatccattctcattattattatttgaccttgatgtcaaagtactatgcactttgtattgtttgggcttcgcccaattctacatttggtggggaaaatggcccttctcttagctgtgcaattgtgatttaagaaaatcatttaggaatcatttgaattgtttagtaataatcttacatgtctgcatttttctggaaaatgtaattcagttagctgttttaaaaggaaacctatgggaatttagtgggcatattttataaaaatctattaacggcgtagatttgtatatagtcttaaagtagttccctatttctccacttctttcttttcaaggactttttggcatctgtatacaatttttttttttttttgagactaagttttgctcttgttgcccaggctagagtgcagtggcgtgatcttggctcactgcaacctccacctcctgggttcaagagattctcctgcctcagcctcccaagtagctgggattacggtgcacgccaccacgcctaatttttgtatttttagtagagacggggttttgtcatgttggccgggctggtctcgaactcctgacctcaagtgatccacccgcctcagcctcccaaagtgctgggattacaggcatgagccactgcgcccggcctgtatacattttttaattgtctataccttttggatgtctataccttcatcctagtagtcagtagttattgaacttaattcctagttctagacttgcctcattcaaaagtatgaatcatgacatctttgaaaggggcacgttgcaaggaatgaattgggtgataatagtgacttattatcaccatttaagagaaaatttaagccagttcagaaaattatagcaggtaggaaatggattagatcattcattgtcagagcgtggtccctagactagcagcatcagcatcatctgggaatttattagaaatacaaattctcaggccccaccccagacctactaactcagaaattctaggggtagagcccagcaatcagtttttaataagccctctaatggattctgatgcacacgaaagcttgagaatcattggattagaaccctcccccacccaaaaaaatgctcggaagagttattaagctattgcaagaaatggcatcttcctgagagacaaatttaagttgaaaccacctggttctgctcttgtcagagatagaaaatggaataaatggccactgataggtctttgtaaccatatgattcccctgaggttagttcctgcctaggtatttgtttccaaaataagtatcccaaataaataccagaacttcatgtaatagtcgaagaaatagaattcagtagtcaaaagggattaaaagcaatttgtacatttactggagactagaaaagtgtcaaaagatgaattcctaatatgcagctttttgcctcgtcctctggctcccagtattatttgtgcacacacacactgacacacccacacactgtaccttccaagagtcacacaaaacccttccctcactcaattcctagtcagaactctccccagaaacagtccaacatggctcatggcttcctagtccctcatctctctttcacttccttctctcttttattccccccatcccccacccccatgcagcatatttttcccctttccagtgtcgattaatgaaaactgattcatttctcacagtcctggaaatctacccacatacattctccatctgtgtaatgaaagcccaataactgattcatattggatgggtagaatggaaaaagccaagaacataaagacagagttctctttctggtggagagagagatggagcagtctcatctctggttgaatggggcctcagagctgttccacctgaaatttcatgatttgggattttgaaagtgccaatcatacattaaattgactttttagggttttctttttttgcacattgtatgctggtatgattaaaccttcattttaacactgtttttgtttgtttgtttgtttgttttgagatggagtctcattctgtcacccaggctagagtgcagtggcacgatcttggctcactgtaacctccacctcccaggttcaagtgattctcctgcctcagcctcctgagtagcagggactacaggcacacaccaccacacccagctaattttttgtatttttttgtagtgacggggtttcaccatgttggccaggcttgtcttgaactcctgacctcaggtgattcacctgtctcagcctcccaaagtgccgggattacaggagtaaaccaccgcgcctggcctcattttaacactgttaagggttgttttgttgatgttctcagagtgcctttaatggttatgaatttcattttgaagaaaaattaggttgctacacaatttcgctgttggttttcatcaaaagtccattgtattaaagcactcatcctgagttatggagagaattgagatttagccctacactgaaagaaatttaaatgggaagtttagtgaccttatgggattgtaattggttttgaggttttaaatgaaaaatatgaggcgggagtatgtgatgctttccgaacaaaaacaatataccctcatgcaataatgaaaaaggttctagattctgtcagttgattttcagtttccacttgcaagattgaaaagttcaattggatttcaggctttattattttctagcatatttttgcataaatcattacccttgcctggaatttccaactcctgcctttcactgatctgaatctgaccccacctcctctctcccaggagagcagcagagtccagaagaaatcacactggattaaaagtcagagagataattagactcctcccacttaataggacattggatgggtgggtcacttgatgttttaaagtctccatttctttcttttttttttttttttgagacggagtttcactctcgttgcccaggctggagtgcaatggcgcagtcatggctcaccgcagcctccgcctcccagattcaagtgattctcctgcctcagcctcccaagtagctgggattacaggcatgtgccaccatgcccggctaatttttctatttttagtagatggggtttctccatgttggtcaggttggtctcgaactccagacctcaggtgatccgcccgcctcggcctctcaaagtgctgggattacaggcgtgagccaccgcgcccggccggtgggttattttctagattaaagaaatgggccgggtgcagtggctcacgcctgtaatcccagcactttaggaggctgaggcaggcggatcacgaggtcaggagatcgagactatcctggctaacacggtgaaaccccatctctactaaaacaaaaaattagccaggcgtggtggcgggcatctgtagtcccagctactcaggaggctgaggcaggagaatggtgtgaacctgggaggtggagcttgcagtaagccaagattgtgccactgcactccagcctgggtgacagagcgagactccatctcaaaaaaaaaaaaaaagaaaagaaaagaacccctctaaaaataatggccagcaacatttaatgagcatttattatacgggaagttcttcccacacatttcatgtaaccatcacagcagctgtttatcacaacacatttatcatttattggcagtttttttcatccccttttaaaaataaacactcatttttcttccaacttgctaacatttatttttgctccccagttttacaaagtataattaataacaaagctgttgggattgtgtgacaaagatactttatagaaatatatatgatttttacatactcacatgtaccacataggtttgcctttggaaccagatatatcatctagatatttgggatgaaaaggaaaaacaggcaacctagaagatttgggagaaggccgcagataagatcaactaggctctggattttaagccttgttgtggaacactccctgatgtggtttttggtattttgctttttttggggtgggggggagcactacaaattcttttattgcaatataatttactaataataacattaatcattttgaagtgtaatctggtggcattttgtacattcgcaatgttgtgaaactgtcaccactgcctaaaataccatcacattttcatcactcccaaaagaaatcttgaacccattagtagtgtttcacaatgtctcccatccccttcattccttttttatggctgaacattatttcattgtatggatgtataacgccatattatatttatccagtgtgatggttaatttttagtgtcaacttgactggattggggaatacctagagagctggtaaagcattatttttgtgtgtgtctgtgagagtgttttcagaggaaattggtgtgtgagtctgagtggactaggtgggggaagatccaccctcaacgtgggtgggatcctccaatcccctggaggccaagacagaacaaaaactgaggtgctcagtatatgttactgcttccccttcatgaacttgacatttcttgagtgcttactgtgcacaaaacactgtgctaggccctttgggggctacaagaagaaatggaacatagccctgcccttaagaagcttgtatcctgatggatggactggaaagggagggttggcgagagagggcatcgggagggtagagtttcctgtgcctgagggtggtgaatgagagagggaaggacccgaatgtgaagtaaagaggaaaaaggtctgtgagaatcagagcactgatggaattcaatggaaagattaatctgtgtgtgtgttgggggtggggctatggggagcagctcatggagtgccttcctttctttacccttgtattcctcccacaactctagcagaaaaatgggtacaaagatgccttaaaatgttggttgtttttatagacacttctggtatgaggttaaaatattctgcaaattgggaggtttccatcaatgggacataatattcgtggccctttgattcagcaactttttgagtccctcccagtctttagggtgccagagattcagagataagacaagagtttagaggacaagggtcaaatgaaaagacccaaagcctggcagggtggtgcacacctgtaatcacagcgactggagaggctgaggcaggaggattgcttgaggccaggagttaaagatcaaccaggggcagcatagtaagacccagtccccctgcccctgccttccacctccacggaaaacaaaacaaaacaaaacaaaacaaacagacctagacagtagcatgtaggacagtaacaaccttggcaaaggtaaacactgtggaggaatgtggcaggtgatcagtcattccttctgcagactgttttggggctcactctgctgagctctgtcatacagagagtagccacagggagggccctgccctgtagaatcaccataatctagaacactggttctcaaggtgtgggccctggaccagtagtgtcagcctcacctggaagcttgttagaaaggcagattctctggctcaccccagacttactccatcagaagttctggaggtgatgtccagcagtcattttcacaagccctccaggtggttctgatgcatgctcaagtgtggtgagcagtgggctaggacagttgtcaggtctggatgcacattagaatcacacgcggggcttttaaagcaacagtgcctaaaccacacctaagactgactagatcagaatctgaagggagacccaggcatctatatttttgaaagctctccaggtgattccattgtatagccaaagttgagaagcggtggtctccacatgcttaaacagatcatcacagtgcaaccaagagtgaccattaaggtgggaaacagtgcctgtgagtccacagagcagaggatgcctggcaaccccttgaagggatcaggatggctccccagaggaggtgaggacccttcattgtatttcctattggatgagctcttcattcctccttccctttttttctggacattgcagttgcacaaatctgagtgtgatcggaaaggttattttaaaattcatttaatgtgattaatttttcaaagttgaacacagctggcttccctttaaaactttgtattttgatagtggttcttaccatgaataattgactaatatcaggtcattaatattctataggagagtacttcaagctaataaaattcattttaaaattagtttttaaaaatgtgttcctgcagcccagggatagtaggatctcagtcaagtatgagattttatgcttttctgttaacataagatagttgtttgactgctcagtatccctgttttattccaatttttttgtaggaattaattgcccaggaaaagacctctgtttcagagttgcaagtttgcctggatgctgttgccctgggaaacattattgcatcaacagtggggaaggggtggctctgacatgggtgctctttgtccttctcctgggtagggcatctctgagagggtatcccctttaggtccttcccagggcttcacatttgggccagatttttttaaaaaataattaaacttttgtattttgaggtcattgtcaatccacacgcagctataagaaatattataggctgggtgcagtggctaatgcctgtaatcccaacattttgggaggctgaggcaggaggaccacttgaggccaggagttcaagatcagcctgggcaacatagtgagactgcatctctacaaataaataaataaataaataaataaataaataaataaataagaaaaaaattgccgaggccaggcgcggtggctcatgcctttaatcccagcactttgggaggccgaggtgggcagattacgaggtcaggagtttgagactagcttgaccaacatggtgaaaccccgtctctactaaaaatacaaaagttaaccaggcgtggtggcgcatgcctataatcccagctcctcaggaggctgaggcaggacaatcgcttgagcccgggaggcggaggttgcagtgagccaagatcgcaccactgcactccagcctgggcaacagagcgagactccgtctcaaaaagaaaaaagagaaagaaaagaaaaagccaagcatggtgacacatgcctgtagtcccagctacatgggaggctgaggtgagaggattgcttgggcccaggagttcgaggctgcagtgagctgattgtgccactgcactccagcctgggtgacagagtgaaaccctgtctcaaaaaaaaaaaaaaaaaaattacagagagagcccatgtaccctttacctggtttcccccagtggtagtatcctacaaaactatagaacagtatcacaactaaaatgttaccactgatacaatcaagacagagtacatttcatgatgccttttatagacatccacttccctcccacccctaccctctcaacccctggcaagcatgtaggcatggatctgttctccataagttcttatggagttcaaaggtaaaactgggtccctggttttaaaaaaagaaagagatggccatagactgtggctcatgcctgtaatctcagcactttaggaggctgaggcaggaagattgctttagcctaggagttccaacatcagcctgggcaacatagggagaccttgtctctactgaaaaataaaaaaattagccaggcatggtggcacatacctgtggttccagctacgtgggaggctgaggtgggaggatcacttaagcccaagagttggaggctgcagtgagcaatgatcgtgccactgtactccagtttgggcaaccaacagagtgatatcctgtctcaaaaagataaaaaaaagatgataaatgcacacaaatagggcacatggacaaaggatgattgggtaggaaagttagacattttaggatttcaggccatacataaagactttcttttggaactgaattcagcactgtattagtctattttcacactgctgataaagacatatccaagactgggaagaaaaggaggtttaattggacttagagttccaaatggctggggaggcctcagaatcatggagggaggcgaaaggcatttcttacatggcagcggcaagagaaaatgaggaagatgcaaacgcagaaataaaatcatcagatctcgtgagacttattcactaccatgagaacagtatggggaatactgcccccatgattgaaattatctcccaccagttccctcccacaacacctgggaattatgggagtacaattcaagatgagatttgggtggggacacagagccaaaccatatcaagcattacttcttggatacactgtgtctttagagggcatctcctggtgttagtgttcacagtaatctacctcaattcctctggtttaaatctggctgtgttttggtaataactggtttatttgttagaggccatggtttgtgctccagccctccttacctcggaatgagctcaagggctttttgacagcctttgggagaaacatgtagagtcagaaggtggaagctggagatgagttaatttggcttctcttggaatggatattctcaaaatgtttgctcaacaattaagcagaagaagcagatgctgtgtggaagaagctttactcatccagtaaatctcaatcccgactgaactcagacttccttatccacatgtgccccagagcagctagacgtgcagagagagaatcacaggagggagctgccaggcttctcactgcagggtggtaaccgccagccacatgtggctattaagcgcctaaagtgtgcccagtgtgactaaagaactgaactgtaactgtacttaattttgatatgaaatttaaatagccatgtatagctcatggctaccaaatgaacacagagattccacattgcccatgttgggctgtttgagtcactccacccctttcagtgggataaaactgaatttaaaaaagaaagagacggccatgcattgtggcatgagcaaggagaggccttacagcttcccccagggtcctctgtaaccccttccccacccagcatcagccctaaaacattgctgagcaaacattttcaaaccactagtgtgaggaggaagctgctaattagcctgcctggacaggagccacatctgtgtccagctgggccagcgcttggctcacagtactgcttacttcatactgctctaatgagtcacacttgacttctctttagatttgcaagctcattcttggggccaggttaagatttgttccctgcatgcatcacttcgttacagcactaagactaaggtgttacatttcttcccgtgccagggaagcagcacagaaaagcggtaactgagaatgtgggtcctttccgccagatgtgagagattaggaaaaaaaaatttaatggtttttaaagtgggtcctgaagccagtttcttgcattggaatctggcttcaagtgcctctgtttctacacctgtaagacaaggatcatcacagcacctctgtcatcatagggtggttgggctgagaaagtctgagcagtgcactttgtccttgggaactgctcagttattacctcttattatgatgatgctggtgatgatgactgtgagcatgataataaagattttctggaaagatgatttgaaggtgtgactctcatgtgtgtccatgagagggcagcctaaaatcatgcatgtctgtggaacaagcagcctctgtaaagcctcaaggtaatgtgggcagtttcaagtgtgtttggccctttttcttctctgtttttcttttttccctctgtttgaagagcgctttcagccattttcaggcttactttagatacggagcaggcccatgaacacctagagggcagcatgggcagtacagagctaggttcaggccctgcctgggtgggtgagtttgtgtaggtgccaatgagagcgtctgtctaggcgtcctaggcttttctttgtaacttttcacacagaactaattcttattaatcagactcttgaggtagacactagaacctgactgtgtttagagaaaaaagaaacttgattttctatgcttgttccccttccactaacttcacacctgcctctgagcattgtgtgcatgcattggtgccaccatgtaaggggacagtggccggagctgtatagacccagagttgcatcagccacacatggctctggaacacaccaggggagactgagttacagagagagcagaataagagtcctcaaaccatgtgggagcacagagcatcatagggctgggggacagtgggggtcttgaagatgggcagggtttaaacagatggagcagggtagaataaaggatggcatgagctagaaggtgcatgggagaaagggcagtgctgaggtaaagttgggaaaagagtttggagtcagattgcggggtggctggaatgagctgaggagttggcctttaaatttttgatgacgttcatattgttgatagtgtcataatgattaagagatgaccaaaaacaaaatgaagaatggcacttggatttttctagtacttatctcattttaatatccctgatatttaatctaggctgcaaaaccagatgtatgtggggaatcatgacaatccagtgtttgtcacgccatcccccttcctcattcccactgcctacactgtgggccaggccttcaggcctccctcctggacagcagcaggaacctccttagaagaagcacaggttgctgtggcagcaaggcacactatgatgccaacttgtgatgctcccagagaggaaggcacagatgctggggaagtgaacctggttatattaacatgaaagctgacttctaaagaatggtgtgcttctttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcaccactgcagtccgcagtccggcctgggcgacagagcgagactccgtctcaaaaaaaaaaaaaaaagaatggtgtgcttaaatattatatacataatatactgggtccagttgtaacagagtgcagtaaattatttgtaatcctaaaatgatcatgaagatccatttaatcttttgtttagaaagccctttagggttctgcaggggttggttggagatgaaaagctccagggatatttctcagacattttcggggaagttgtcatttgttccatcttatttgttgtagatatttggatgattctaagatactaagattgacattggcacaaacttggcagaaccaaaattgaacttgagtgttgtctttcatagtgctcacccaaggagctcatacgttggctcctttcagaaagtaggccgggcatggtggctcacacctgtaatcccagcactttgggaggccaaggtgggcgaatcatctgaggtcaggagtttgagactagcctggccaacatgatgaaaccccatctctactaaaaatacaaaaattagccatgcgtggttgcacgcacctgtaatcccagctactcgagaggctgaggcaggagaatcgcttgaacctgggaggcagaggttgcagtgagccaaggtcgcgccaccgcattccagcccaggcgacagagtgagactctgtctcaaaaaaaaaaaaaaaaaaaagtaaaatgttcagtgtctgtgtaatgagcagtattcaaaattttgtccatttttgtgcttctcctctcccccaggtggtcctgcttcaggcttgggagcctgactagacgaggcctagtgggcttctctgcacactgccaggcccgtctgtcacttactgtactttctgaccccttgtctgcctgggggcaaaggattaaggaaggggctttgtcctctggggctgatgttggcccaactacaggacagcttggcaggtgcatgcgaaagtggtagctgctgcccctcagctgtgtgtgtcatggagagtgacagattggacttcctttggttgaagtgatggagatggatgatgtgcacgtgcagtcagactcgggtgccatgcccagttgcctatagtacttagcagatagggaaagagtgaagaactgaaacataatctagttttctcctttgtaggcatggagggatttttgaaatcagatgagaggcagagattggccaaagaaagacgagaagaaagagaaaaatgtctgggtaagttatgcactttggctattttggtccaagggagtggagatatggtggtgtcttttctgaagattcttagaaatttgtgaatgaatgggaactaggacagttgctagatgaacatgaagaatcaggcgtgaacctacactgcaactggcatgttcacaaataggtaattttcagaatagttcactcggcaaacattgaacctctgctgtgttctagccactgtgttagggtctgcagttacgatattgaagaaagagaaacagtcgctgcccctgatctaaggaagtcctaacaccttcaagtgtcaactgtgtacactccctcaggttctctcttgggaatctaaaagggccatcctcaggagaactgagaaaatcagcacttgagtcattttatattttaggacagagagccctggttgagaaaggccgtcttgcctcttgcaggctgtagacagattagtgcagagtgttcttcacaggatgctgagggagatagcgtttccccattgcattgagacaaatgaggagctttcaggttcttctcttcttcactgcctcctgctggtcggtacaagcattgcctcctccagggaacccttccctgccttggctaggtggaattaagggccccttagtaaatgccttgagggtaaggcaaattttgttcgtgtgttttaccccctgacttagctcagtgtctggtgcttggtgcacacacagttaaactgcttttgaatgaacatagccttataagcatcattgctcaacctagcatatagtttagccattatgcacaagtttgacttaatgacagccgtcatagtcatagctcccacgtggggaggcacttactgtgaacttcacggtcatcatcttgttcaatcttaacaacactgtgatgtggcaaacatgactgtccccacatcgtagaggaggaaaccgaggcagagagatgatctagctaacatgcttagggttacccagctagtggcagaggtaccagaaccctttatctcaatcactgcatgctaggatcctaccaggctctttttagggctctgctcttgcttccttgtttttggtcttaatccaaactgcatgggatgctctggtaatgacacctctcttctactttccttccccagctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggtaaggcccaggtgcaccctccgccaccttccagccccctcagcaggctgctcagagtgcctgggcatcctgcccagctctggggtaggagagagacctgccgtgcaccttctccttggtggctcccatgccttctttcagcaacatgacatgaaactcgaagcagcactgacatagaaccgcagagacttatccattcaactcaggtgttaatttgctgtgtgatcttgggcaaactggttggcttctctgggccttgatttgtgtgtctgtgaagtgagggttggatttggcagtctccaatgcctcttttagtcataaccttttctgactctaagactcaaagggtccctggtggtctagtagataggggaaaaaaaaaaagactcagaggagattgtgggtagcggctgggtgaggtgaatctgaggattacagatgggagttcatgcctccagggcaggcacaaggccagaacaagagcttgtgaggttgagaacaatgtgatcctgtcagttgctactggcaaattagtctaccctcaaataccaagatgctaatatatttaaagtttaatgtagttcttcgctttaattgctctttccagttaccttttaaaaaagaaatggcacataattacccctacagagttctttattactaaattttgaaaatatatttagaaagcatatttggattatagattttcttcacgattatatttttaggaggtaataaaaaccttatgtcagttgatgataattttttattcataaggtataatgattcatcttttagtatgaacaatatagaggtttggtaatctccaaccctataggatatgaagatgtttgtacaaattcagtattttttaaaatctctgaacagttgcttatcactatatatatttaccccttccttcttttttttttaaagaacacatacgaaaacacacacatagtcagacccatctttgcccaagaagcaccctttcatggtgatttctttcctcctcttagaaaatgaggtctaagccagtgtcttagctatggttcaccgttattggctgcagtctgattgctgtgccttcatctgctcccagttcaaatgtcagctccaatgccagctctaccactgagcagctggtggccaggggcaagtcacatgcccctctaactctgtctccttagcccaaaacagaggtagttacaggaattaaaagaggtgacttttgtaaaagtgcccagcaaagcacctagcacagagtaatcgttcaggaatgttacattctgtttagttacttcagctgagcttggctaaagcaaggtcaagagggtgctacccacaaaagcttatgaaacagagtcagtagatgggaaaaagccacagtataataggctgttttggtaacttgggacagatttctcctttcctaacttctgtgttaagagttgctggactcacccattttcttcccatcctccattccttgatgacttagagcttgtcctcttcttccatgatctctccattttgaaagcttgtcactgctgcttccaggaaggggtactgtgaagtcacataagacacttcccatgctctgacatatgcattgtcactgggggctgcttttgaggcaatttctgtttataatttttctctacagaacattagtgctggaggcatgttaaattaagtagaacagctcccccttcttggaggtgagggagttttatgccatatggttggtcctgatgcagctgaatcttttgtggtttcccttctgggtaattttctatttgtgtgcttccttgcacccctaatgtggtggagggaagcaggaggctgcccgaccgacccttgtcagcccaagctgagcttggttccctcttctccctgggcacagcagggcagggctgagggctgggcctcctgtggttgtgtagcaacccaaggaaacagcagcctccttctgccacctgctcctgccctcagggtcccaggggacccaggtgtagcttagggacttgccacacacaggctggcttgttagctacattgggtcggtgctctgctggcacagaggcctttttggcattctcgtgggtgacatttagggagaagggatcagcctgcattacggaagcccctcttcaaaggaaaccctctgcactggcccctatgattcaaggggagctctgggagggctgcagcctgctcagtgcctggctgtggatgttctccattctcttctcagtgtcagattgaagtctttttttttttttttttttttttggtcatgttctgtctctgtcagccagagaaaagcctctgcaggaagatcattcatcctatgcaggccattttacttctctagcctgttggaaagtgtttgttgcccaccaaatcctgcctctctgggtctgatacttaggagctcatgagaggcctgttgaccccaccccagccctgccctggctctgtacccctatggttgccatgatgtcactcttgataacccctcatgtctgtgccagggcagaagtgggtaccaccaatggcctgtctctcagaggtcttaagagttggcagaggtcttaagagtagtcaggcctgtcccagggaggggtcccagggaggggtggggtggttctactgtccacttgacaccctgaccttaaactcattctcttgctggaggccacctactccttaagttcttagaaccttcacgtgccacacagctcccaggaaccaagctaccagaacaagttcctgtcacctgtgttagggctgacaacacagtatgccagcccattctcagggcagtatagcttcctgaccagtggccctggaaaattggatttggaaaagccaacttcatgttccttatgctaaacagaaaagagaaaggcctctttctctttctttctttctttctttctttctttctttctttctttctttctttctttctttctctctctctctctctcttttcttttcttttcttttctttcttttctgcacacatccctgctgaggaccgctgggggtgtgtccctgcagtgtcatccccagaacacatgtaatgggccgggcatggtggcttatgcctgtaatcccagcactttggggagccaaggcaggtggatcacctgaggtcaggagttcaagaccagcctggccaacatggtgaaaacccatctctactaaaaatacaaaaattagacagacttggtggtgctcacctgtaatcccagttacttaggaggctgaggtgagagaatcacttgaacctaggaggtggaggttgcagtgagcagagatcgcaccactgcactccagcctaggtgacaaagcaagactctgtctcaaaaaaaaaaaaaagaacacatataatggcagttgaaaaggcacagccaccccctaccacccattcctgccagagactgctgtctgagtaacagtgtctggaatgtgccctgctggcaacctttaatactgttcagccagttcagcggggtcaccttggtcgtgattctccaagttcatccagacagatctaaagccagacctcaaggcatcaagtgtgaggctcgctccttccttctttccttccttatctccctttccttcctttctatctttccttccttcctctctttccttccttctttttttccttccttctttccttccttccttcctatctatcctttcttccttcctgtctttcttccttcctatctttccttccttccttccttccttccttccttccacccttccttccttccttccttccttccttccttccttccacccttccactaagccctacctaatagaggagattctagggacgaggatttgccttgccctttccccatcctctgttgatcatcagatgatactcaggagaaccagaacttggcaggaattgcagtatgcagttctgatatttattaatactgtttttctaatgtgatggaactttctcatgctcactttctgttgctcagcctttcctctaaccagtggctcttgcttgggggtcccatgaccagcagcacctgggaacttgttagaaatgcagattctcagcaggctccaccccagacctattgactcagaaactctggggataaaccccaggattttaataattcctccaggggattctcctacctgatctctcagatttgagaactattgctctaaatggtcctgataagaatcttcctctttaaattcagattcacttagctttggttaaggacttactgcatactagtcattatcaaatagacttagagtgatctggtgatgtaggtaagctcatccccattttataggcaaggaaactgaagcccaggactgcaatgttagctcaaggtcacagggataaaaagtgtcaggcagaggtgggatttgaatccttacctcctgattccaaatctgagatcctttctgtttcgtcatatgaaggaacaaaaaggtacacacaaacacgaggcaatactgacctattcaggactaaccttaaataagacttgtgcactggacaagttttgttttctatatgtatgaatcaccccattctgactttttggggttccataaatcctcttctcttagaacttgcttatcatctatttctcatcatctctccaaaagtgggtgatacaaagtgagtgtgtctttctctcagggacaactgtgttttcatcggcctcctcaaggtctgaaggaatgaatctccagtggtgggatttggagcagctcagtggactggggatggatggcaggggtagtttttctagaggccattgaaaagtccaggggcaggtctggctttcagtgagcactcattcccttacaagggtgccccccagatagctgatcagtggtcaggctggttcagtgaagctcactattctttcttttcattggtcccctagtagagaagggaccactttgtgaggtccttctggcatgtaggaaatctaccgtaacccacccaatacttaattcactctaggatgaaaggtttcaacacttcagttaggtcattggttaaatactttacgttaaaccgtataatgaaatactattcagccccaatctcgagtggctgtacttcaggcatcacatggcagagaagttctcttccttccaagccccagcttttatcaggcagactgccagagttggccatcatcgtttaatgggccagggtcgtgaggactggactctgccaaggcatgcatactcacgattgtagagtctcaggccaaatacaagagcacagttaatagctaatacaaatctaagagttacaggaggtaaaaatccccctttctgcttacaggtccctggagaggcagtctcttagcaaagtgctattcagagaaaaattatgtagaggaggctgagatgtggagaagccagatcctcatctcatccctctggtatagacagaagggataaatccagatacctattaagtgacctttatatgtttctagtaagtgtgacataaaggagcctttcctgatctttaagtcatggttactcagttgatgatgtcctaaattaattttgcttctgtgtgtatttttttaagccatgacaattgtatctttttgttttagaatgggctatgattagcccagttcctggagcacctcggggttgggttttatgagggcaaaagggtgtcattataactgctagctcaggccttctccagtggagatagggagaggagttggtatttgcagtgtcacggaggtggtggggagtgcagaattagagcaccttcactgcagcagcaaggacaactttatgaaagtaacaatttgggtaatacaggagagtgtttttgataaatactgttacgagagaagccgaagcctaatggttgtttttctcttctggttaaaaattactgggttctgcctccctgcctcctccacctaagtaactctgggaacgcatggatgcttttttttttgtggccagaaggttctttactcttgcctcttgaaaattttgaaatatgcaatattatcccagattactatatagcagaaaagcgtcacactatgtaaaacagttggttcccctttaagaagttctaagatgaaaatgcagctttgcaaaatagatctcagtgtcatgtatcaccccaaaaactcaaattatatttgcattaaaattttctcaaagcaaaatgttttatgcttttaactagaaaggatgctcttggttctggagcagaattccagctctcctggttagggcaaaatgccttgagataggcctcaaggagttaatgcttattgggcattattcctagggcagcttctccccagggaggggaggggacaggacacacggtgtttaggttgagagccagtgctagcctagccgcattgtttactctccacctactcagaacacgctggtgtggcagagagagcacgtatgcctgggttttggatgctgagcacagaaagccccatttggtgactcacactgtgcactgaggcagcaggtagtgtggtggggctgggtagttaatcttgttaacacttgccttacacgaactgtgtaggaacggctggaggcgatgatgcgccggtccctggagcgcacacagcagctggagctgaaaaagaagtattcgtggggagcaccactggccattggacccggaggacatgatggtgagtgtagggttgcccctgtatttcaggtcctgggtgggaaataatggagcaggcaggggattatgggcaccactgggtgtctccaggatctgggggatgctttgcacagcttttcagaggcaccactttcagatgtgatgtttaaaactgccaagattcctacgcatgcatttgttatgaaggggatctgtgcattcttcttgatagcaaacagcagttgacacaaaaactgggttttgagggagagcaaaagagaagactttgaacgcagagcccagtgagctgggcccagctggcaagcccagggttgttctgacttcaggggagggaaacggcaggaggctctgtcactggtccagatgcgatcaggaaaagcacagtggcagttatcctccaaaaagggctggactatttcctgctgcattttaaatttttgttgctttttcgactttgtttcaaggtgacttatttcattaccagttcaaactcatctttaaattttcaaatgtgtaatttaatatatggattgttactagtctctggatggcttttccttcttttcagtgtctcactacatttcagcgatcttagcattctattatgcaggaggtgtgtactagctctatctgagagcaaatggatttgtgtttacaggacagttcttgactttgctgtattgtgcttttcacctttgggcagtaaatatactttattttttcttttttgaaaagtcaacaacccatttcagttactttttctaatttcctaattagaaactaagaagcaacaagaaattgggacttttttcttttacctctctttgctctgattttttgctgtgtaggtgaatcagaaaataccccaccccctcctctaggtttagcagccagcaccctccctccggatgcagggaccactgccgcagctgccgagtccaccaacggtatatccgagcatcactgtgccatagcattttgtgataactgttctgatcatcctcccccatcaccatgtctgcgtcaagcacttttacaattggtttcttagtctggcctgtcacaatttttttttcctagcaatgtgaatgacatgcccatatttctttgttcctctgtcattatagagcggtgcatgccttacatcttagtgccccggagacatttcatcctcaactcactaacgtctgccttgaaaatcttgtcagtgttggatttttgcacactcagatctttaacaatctcttcatcatctgttgtagacattaagaagcagggcatttctgattacttctggttaccaaaacctgtaatcacccggagttctgaatggagaacttgggcttagtgttaaagtgatagattcctggagaggtgtttgagagggagtggtaggaattttatcagtgctaacactggtaatccaaataattagataatttggctttgtgcttgattttatttaataggctgtctgttttgtatacaggcctgggaaactcctctggtctagatcaagaacagaactagccaaactttgtttccatttaataatgactttagaaattcaatccatcttcaactggcaaagaaaaaaaaaaaaagctgtaaaagggatgcaatatttaccaacaatgcggaaggtcatattagcagtaggaatcaatatccttggtttctgacattcctttgacaatgaataatccttactgggggtgcttcgtaacagcagttttgctgcacaagcagagttacctctagtgtgggcactggctttccccctaagaaaggtgcaggggggctgggcgtggtggcttgtgcctgtaatcccagcactttgggaggctgaggcaggcggattgcttgatgtcagtagttcgagaccagcctggccaacatggtaaaaccccgcctctactaaaaatacaaaaattagtcaagtgtggtggcgggtgcctggagccccagctactcaggaggctgaggcaagagaattgcttgaacccgggaggcagaggttgcagtgagatcgtaccagtgccctccagcctgggcaacggagcaagactctgtcttgaaaaaaaaagaaaaaagaaaggtgcagagaggtggagtaatcacccactgggaatcagcacccagggcccgggccagggtgaaatgagtgcagtacttgactagagcatacaatttaagggagtgccaaaaatctcagtaataaagataaaataatatcttaatgtgatattttttaaaatccaaattaatgcaaaacaatccataataaacaacaaatttctaaagactggtgccatgctgagcacatcagagcctgaagcaaaagggaaaatgtgtactcctatatacgtggttttatgtaatttctaatgtttagttttatcaaaacattaaagtagtttaaaatatggaaaaattgaaaagagtattaaaactcatataatttcaactttaaatagttttatttctacacaaatcaaatttattgtacttttacttcagctttagttaattaaaaattaccgggccaggtgcagtggctcacgcctgtaatcccagcactttgggaggctgaggcagatcacgaggtcaagagatcgagaccatcctggccaacatggtgaaacactgtctctactaaaaatacaaaaattagctgggcgtggtggcatgcacctgtagtcccagctactcaggaggttgaggcaggagaatcacttgaacccgggaggcggaggttgcagtgagccgagatcgtgccactgcactctagcctgggagacagagcaagactctgtctcaaaaaaaaaattatttaagattgtcatttggtcagcagaaattatagaacatcgcagttcttatggcagttctcatgggaaaacacgatgagcagaggagtagattttgaaaatattattgatgagtttgcttttttacaaccaagagcacacatttttcttttggcctcaggctctaacttagcttggcagggcactgtcagcatctctttgtttgccgtctgaaataatgactggaacgtaagaacaccaaactcagggtcgcctgttaaaatgctaacctcaaacagttaaagcatttgcaaaaggaccattttgatctgtctcttactaagtaagaaaaggaaaaccaactgctaaagaggccgttctgctttaaatacaactctgagaggacggatttcatctctctccaacctgagctacagataaccttcataaaagagtcggtttcagcaagcggtgacagtcagaccatagggcgttttccagtggtgatttgtctctgggtccaagttggttttgtttttgtgtgatgtgagcatgctcaaaaatccctagacaaaagaaaatgatttgttggtgggattaacacggcttcagttgaacagttgagtgaggttgaacatttgaaattgaagatgacaacacagtgaagaagttgcagagattttgctgcagaccaagggctgctgtagcctggtcatttctagagtaggataatgagatgccaggatgatgaaagcagagcatgctgtgccacagcatttaggaggtgcgtggatgaggacaggaaggacacttcgggatatgtgtttcttggttctacagtagtgtgatgaataccaatgtctttaatgcatttctctgcagcatgtgacaaactttcaacatcaactatgagtttgccaaagccaacggagcctcccatgaataaacgcctgtcttcatccaccgtggcaatatcctattccccagaccgaggcaagtgaacatgtagacttggtctctctagtttgtttcttttctggtgtgagcatcttaacgtttgtctttgtgagagtctcctcttgagccttctgcagataccgtcattgtcctagtcttgtggtctgaatgtgggagctctagggccttgtcagtgggactttggaacgtggcacggctctttagagccaggtcgttgttgaatagaggtaggaattaatgcagtctcccagtctgaaagagactgttctgttttccacattgcatgtaggagttatcctgcccaggaattaattaaccagtgggcagatgtgaccattaaagtaactgcctggtcaatgatggaatacagttgattagccagaaagagcagaattgataagttatagttatatgggaggcttagatatgtgaaaaaatggggttctgcagtcatctgtggtttataggcctgcccattttgtagatgaaaagagaagcacagaactaatgaggcctctaaaagaggaaaaggttgggtggcgctctgttttgagttaggagatgatgtgtatgggacgtgtgccagttccagaacctgagtagatttaacagggtctgcattctcacaaaggctcagataagtcactgaaagtctgtttatacctttcagagtatacaggttaaggaaatgacggaagctctccatgcactaaatgtttattctaaagcaacattgaagaagtatcaggtgccagtggagtgtttagcacaagttatcaccaagggcagagcaaaaggctggttgcgacttggcagaggctggtgtgccttcctggttgtttccactgacattgaccttgtacctctatcccagaggcatattatgtgtgtcagagaccctataaggttcataatgctactgatctgtgatgcagttcatggtaagcaccaggaacctggaagtgatgaagagctgaatacagagtgagggaaaagttaattcattgccatatataatacattcaaaactgatctaaatattttggtcattgacttccagattatgaatactactatttgtctttcattaaagctgataatcagttggctgtttgtatttttgtgcctctcacttaatttttacccttattgacatgtaaaaagtatgaaaagatatatttttatactattacaagatgacattttatttaaaaatcagtgtgttatgaaatgcttcttagcgcaggacctaaaacaagtgttttataggcataatttgttttctacttggagtaaaggtttttttgttgttgttttttttgttttttttttgtttgttttttttttgagacaggctctctgttgcacaggctagagtgcagtgatacagtcttggctcactgcaaactctgcctcccgggctcaagccatcctctcacttcagcctcaagtagctgggactacaggcgcatgtcaccatgcccagctaatttttttgtattttttgtagagacgaggtttcgccacgttgcccagggtggtctcaaattcttgagttcaagtgacccgactgccttggcctcccaaagtgctgggataacaagcatgagccaccatgcctggccataaatgatttcctgagtccatattacatctgggaggtgggctaattctctgagtgatacaggttactgtactgcaatagcatattgaatggattttggtacctagtgacaattaatgcactctcccaaactctaaaggacacattatttgttttattttacgatgacaaattccaaatccatcctttgttcaaatatttttattttccatgttctgccacccaaaagttaatttgcaccatgcattgtgttgtttaaatgttttattttgttttgttttaattttgctttttaaaattttcatttgattccatccctcagctcatcacatgcaccttagtccaatggaagccattcttgtttcgcgactgttgacacccacacagtcttctttagccagaagcagagcttcagtcatgctctctgggcaggccaatgattcaggtaaaagaggctaagctggtaacaccaaggaaaatgcccgaagaggtgttggtcagcctaggatttactcctgaatttttggattttgcttcctatttgctggctttgtgaaaagtcttcattggttaataacgtcttataccagtgttttgctgttttatgtttcttttgagtgtcacagaggtgagtaaattatcttatgagtgagagcatgttctttaggggaagaaaaccccacttgatgaactctggaggttagtagacttttcttaagagacggtgtggcaaaacagcctgtagaccagtctggggtgtcccatagccagctctaccactcactagctctcaccattgggggtaagttaattaacttctttaagcctcagttttctcatctataagatggagctattttaaattattttgaagattaaatgagagagtgcatgcaaatgagatagcacaatgattagcacagaatgaaagctagaaactttgagaagtttctagcctcactactcaaaaggtggtccatggaccagcaatggcagcagcatctaggagcttggttggaaggccccacctagcctgcacactgaagtctgagaaacactggaccagaccatcaaagccctgcctttatcaaagcagatcaagtcgtcatgtcaggatttgtggcggctggcattctctttgtttccagatgagcagcactgtgtccacctaaggtcaggtctactctctgttctccagatagtgtactcagttgtgatgatacataaatgagataaaacttctgcctagttgtagctgcttccaaacagttatactgtttctgcaaataagttgtacagatagctaataggttcataagatgctcaacatcattaatcattagggaaatgcaaatcaaaaccatagtgggatgccactttacacccactaggatgactagaatttttttaaaaggggaaataaccacgtgttggtggaggtgtggagacactcttccctcacacactgctggtgggaatgtaaaatgatgcagctactgtagaacacagtctgaccgttgctcaaaaacttaagcatagagttcccatacgacccagcaattccactcctaggtatacagccaaggaaattaaaaacatatgtttgcacaaaaacttattcacaatagccacaaagtggaaagaaaatatgatatacccataaagtagaatattattcagctataaaaagaaatacaggccaggcatggtggctcacacctgtaatctcagcactatgggaggccaaggtgggcagttcacttgaggtagggagttcgagaccagcatggccaacatagtgaaaccccatctctactaaaaatacaaaaattagctgggtgtggtggtgcacacctgtaatcccagctactcgggaggctaagacaggagaatcacttgagcccaggaggtggagactgtagtgagccgagattgcaccactgtactccagcttgggtgacacagcgagactccatctcaaaaaaaaaaaaaaaaaaatacagatacatgccacaagatggatgaaccttgaaaatgtgctaagtgaaagaaaccagttgcaaaaggccacatattgtgtgcttctatttatgtgaaatgtctgaaataggaaaatccatggagatggacaatagatggtggttatcagagactggaggagggaaggaaggggagtgactgcttaacggacgaagtttctttggggaatcttgaaaatgtttttagaagtagactgtggttatggttccacaaccttgcaaatgtagcaaaacctccaaattgtatgtgtatatgtatacgtatacatatacgtatacatatatgtatatatatgtatatgtatttaaagacagggtcttgctcttttaccctggctagaatgcagtgatgtgatcatagctcactgcagcctcgaactccaagccctcctctcacctcagcttcccaagtagctgggactacaggcacacaccaccatgcctggctaattttttgggttctttggagggacaaggtctcactatgttgctcaggctggtctcaaactcttgggctcaagcgcgacccatctactttggcctcccaaagttctaggattacaggtatgagccaccatgcctgtcctgtatactttttaaagggtgaattttatggtatatgaattatgtatcaaaaaaccctagcaagtaggaagtaccccattttgagaataaggaatatgttggggttccctaagagcaactccaggatcagtgatttgctaggaagactcacaggatccccagtgaaaggatgcaagcaaagtcagcaaaggagaaagacacatgggacaaagtcctgggaagaccaggcacaagcttgcagagtcctctctggtggagtcactcaggacgcctttcaccccagcaatgagttacgacaacatgtatgaaatgttgccaaccagggaagctttttagagactcagtgccaacggtttttacagagggctggtcacatgtactccatgcccagcacatacccaaattccaggttcccagaaggaaagcaggtattcaacatacaccatgttgtttgtttatgccctgtgagccactcaacagttaaagggggatcgtcctaaaatgtacgttcccaggtgctggctaaaggctaaccttgtaagcaggccttagtagggacagcagtcaggcttgctatgttaactcatttttgcacagctcacccacttgacccttggccaaggtgtctttacagaaaatttttcagtagggccccacatagcagggggtgagaccatcctgcagtattgatctcagttatgtcctttaggggttctgggacttagcagttaaagcaaatctcattaaccagaaggtctgtcttttttttctctctttcttttctttttctttttcttatttatttatttatttatttattttggagacaaggtcttgctctgttgctcttagccacgctggagtgcagtggcatgatcatggctcactgtggcctcaacctcctaggcttaagtgatcatcccacctaagtctcctgagtagctaggactataggtgtgtgctaccacacttagctaattttttttttttttttttgtagagatagggtcttcctatgttgcccaagttggtctcaaactctgggactcaagcgatcctcccacctcggcctcccaaagtgctgggattacaggcttaagccactgcacctggccttagaaaggtctgtttgaggcagccaggtggcctcctccatcagttgctgtatgaatctttttacctggcctgtggcatcagctcaggcccagaacagctctggccagtaagttgaaactgatctgaatgccttccaggcctgacgccgtgtcatgataatcgtggcacgcacataggaactatgatccccaagggctcatgtggttccctggaaaaaaagagttgaagatgttagggcacactagcagggtatcattggtcagtcagttcccagtgtggcctcccactgtggtgactggtgcctcagggtgctcagtccagtgcaggtaattcagctcagtcccaggttttatggcggctgcctgaggccatcagtcccaaacagttctaccagtgaccctacttcatcttcctggcaagtgcagatggcatctggagctgttctgtggggacatgtaggaactggccccactcctgccggctcatagtcatgctgtcacatgccatctaggctcagccatgggtctgagtccaaggtgctttcagcacaaggagttttccttcaggaaggagagcgcttccaggagcagttatggaaaacagaacacaaatgtccttccgtatccctgtatcatttttaccccaggtgttggattatgttgtttttctccatgtcctattcaataatcaaaactttacattttcttaatcatcccctactctcacccagacctttcaaagaaaggacaaaagcatttcttaaaacccatttttatccaacttaaccagaaagatatattgtgttcaggtattaggctaaaatcctaagttttcgaaacattttaaagtaggtttgtatcacctctgagccctttcatcttgatcattttatccagtgagcagcctagaaaagatcaatccctttccagtgacagctgcatttaacaaattgctttactgacgtgtgtagtgagagaaaggtagaggaaatatagtcaggatctcagtctattacaaactgcagctactccagaaaattaaacacaaagcatcaacagcagtgacactttccccagagggaatggagttcagtctgtcagggatggctgaaagagtcacattgcctgtggtgtgacttggagcttttgtaggaatcatgtgttgggaatataatcagactctgcatcagaaataatagagccaatgagcagcttgattgtggatggtcccatcagagaacaagccctgtcttgtgggcacttgtatgtgacccagtctagcagcatccagaatctttttacagttttgggccccatgaagggcattctatatttgtagtggtccctactcgatttttaaaactccagaagcatgtcttttcctagaaattgcctgtcttttcatatctccccttttcaagaggctccattagacaaaagtcatagcagaaaaatctactacagagacttgttctggttctaatatttggagtttaaattccagcctacccactgctggcaaaaagcaaggaggttgtgtctaactctcacttggaggagaaaacaaaaaccaaaggcatcacttgggctgtgctttttccctcactttagctagcatgctacagtcaaaagcagccagggggatccatcaagccaactctcttggagctgtattggtcatctttaaattccgtaggtcacttttacctctcaaaacagctcagctgctgttttataccatggataacttcatagccacccaggcatcacaagtttgttctccacccttttgtccttttcccaaaatgtgattttaccacgtttcagcaaatcagggtcattccagcaattcccatttctgacactagttgtgccagagttccccaagaccaccccaggtttgatgattggctaggagaacttggaagaatcagcatagttccacgcatggctgtgacttattttttctttcttagctttttttttttttttttttttttttcgagatggggtctttctctgtcacccaggttggagtgtagtggcgcgatcttgactcactgcagcctcaactttccaggctcaagcgatcctcctgcctcagcctccagagtagttgggactacaggagtgtgcccccatgccaagctaatttttgtattttttgaagggctgtggtttcaccatgttgccaaggctggtctcaacctcctaagctcaggtgagccaccatgcccggcccatggctatgatttattatagcaggaggaaacatgaaaaaactagcaaatggaggaggtgcatgggactaagttcagaagtaaccaggtgtggatttccaagagtcttcttccagtggagtcacatgggacgagcttaattcctctaccaacacattgtgacaacatgtatgaaatgttgccaggctgggaagttggctagaaactcagtgcccagggtttttactgggggctagatatgtaggcatcccctcccaggcacatacccagattccacactcccacaagaaaagcagatgcttagcataaaccatactgtttgtataaacagtttagacacccatcagttaatggtgggaaccctcctgaaatctaagttctcagatgccagccaagggccacccttataagcaggcctttccaagcacagcagtcagatctgctatgttaacccttttgtgcacaaggaaatcgatgtttagagaggttaagtaacctgcccaaggtgatccagctattaggtggcagtgctaggtctctgtggctccaaagtacagacttttaacccctgaaataaacttgaataaacttgactcttgagtatgggagcctttttagggtaagatccatcctgtgtacaatagaaaagtatgatattgattgcccaggtcatattttaacagaaatgtgttcttcccaactctctgctctactttttccatctgtactctctgtccttctggctgttatactgtaactttctagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtaggtttaaaaccacccacccactcactcctctagactgtgttctgtctgatggtgtgattacttctgtgcttgacctgggctgtctgtttccatcaatctcctgggactgctcaaagcaggaaagggtagatttagttcaaaattttacccaacctttgaaaatcatttaactttttgcaccctcttaagtcttagtaccttggagcaaattcttaatgatgtccttgtcacagcctgccctccagaggacaggagtcagaaggaatgttctaaatatcctctgtcttcctcgttacggatatctgattctgggtcagtcttgcccgtgcatctaagtggaactgaggatctacgtcaacttttacctacaaaagtaatcattaaatattcttttgagatgaagtctttttatgttgcccaggctgaccttgaattcctaggctcaagtaatcctcctgcctcagcctcctgagtagctgggactacaggcacatgttactatgccaagcttaaacatttttgatggcatactggcactatcagtaaattaaatgttgagaaggcacccccaattgtgtctatttatttagaaattacacagtgccatactacttttgttagttattgattgctacttaacaaatcacctcaaaccttggcagcttaaaataacaaatatctattaattcatgggttctttgggtcagaaattcagagtgacttagtggttctggtacaaggtctttcatgaggtgtggtcaagatgttggccagggctgcatcatctgaaagcatggctgggcctcatctgagacggctcattcatggctgttggcaggaggcctcggttcctcactgcatgggcctgtccataaagctgcttgagtatccaaatgatgccacagctggcttccctccaagcaagctatcgggaagctgcagtgtcctttaagtaagtcactaagatcaacccacactcaagaggagaggaattaagcctcacctgtcgaagggaggaatatcaaataatgtcaggacttatttcaaaactacttcattttataatgccatattttcttttcaaatctgttgtggctcttagaagtgcatgttttagactctcggattttactatacagtggattagtgttgaaagggattgatggatgtgagtgtgggggccaattgaggacttgctgcagaaaagtgtgatagggagagaagggagctaacccttgtggagcactttctgcaggctgggcactgatgtctgttcccttctgccaaaggaggtaatgggaagacctacaggactagatggggttgcagacccattataccatgtataccatcaggggccacagctcactgtcttggatgttgtaaccacattttcacccacctgtaatttttttgtagtgattttacatttttatactcttttcagttcctatatgtctaagaccgtaatatggttcagttgttaactctttgaaagacaacaaggagaaggaaatctttgcattttgaggctgattttttttaactggataatgcaaatgtgatgacctcatcctgcctccccgcaaagatgcctgtcatgtgaagcgttatagcttcatatcgatccctctgaaagaaagctgtgcattgttccatctggggtattagtcttataaattgtggaagtagtgccagtcatggactgtggctatcctgtgtcccctacaggtggagaaggtgaagcgggggcaacgaacagcaacttctcttcctgttgtgaacttcgggtcccctctgagaagatgtgagttttctggaggcattcctaagagaccatcttctcctgtgatatccaagtaagcatctctcccctttgccagacagtctgactgtcatgagtcagtttgctagggctttgtgccatccagtgttgcagctcctgctcccccgtgaggcgtggccagccagaagtggtaagtgggagaaatgctggccttggagttacgtggcttgactctctgtgtatcttctgggtgaaagatcctttgctaagggaccccagtgcgtaacagggcttttatttaccaagatgatgcattcagcattttctctttaggtccatgaattccattctgcttttctggtattctttttccagttgcatttggatttaagtgattgcattgggcttgggctcctcctgacattctcccccaccttgttgtctctctctttaatagagagacaataataacttgtcagccatgatcaacagtattttaatgaagcaaatatatatgtgtgtgtgtttttaagaaatggggtcttgttgggttgcccaggcctggagtacagtgactgttcacaggcataatcacagcacgctatagcctccaactcctgggctcaagtgatccccccgcctcagactcccaagtagctgggaccactatgcccatgcaccataacaccaccatgcctaatttttgttaggaactaggtaaactcaccaaggaaaccatgtaactgaaaaatttacaataactttgtgaccaccaaggtcttaagtcattaaaatattttactgacagtaactgacaaaagactcagtaaataactcagtccagtaggacagtggaaaccatctttagtaggacagagaaagaaagagaaatatgatttaatttgggaatataggaaagtttttatatggagagaatcatataaaccttattcagtgtatcagtttagttcagagaatgttggataaacacaagtttaatgaaaacttgcgaatttgtcaaaaatatttaaagatgacatcagctcttaaatttccaatgtgttgctttctaatagagactttttcactactattaataattttttttagagatcactatggttttgatacactactaatacctgccattgatgtgtttgtcctccataaggaaaatctttccatagcacatcactgaattaaaagcctacttttctttctttctttatttttagttcattgcaacctttctgtgctagtattgcccatctttggttatggtgttgttatcctaccacctctttaaatttattatgtggactctacgatccgtttccctctgtcttatatctgagcctttttcagcttccacccatgcatcattactctggtgttaattttggacatttgcattaacagaaagaaaagcctagtttacgctgagacttttacaggctccaccctctctctgtcttgctggaatttggactcatggtccctgcagggatactagcttgcaagtttcatcattattattgtaaatggtagtatcttctatagaaatgagaattataggtatacctagttttgttgtactttgcacttcgcaaatactggttttttttgttgttgttgttgtttgttttacaaattgaaggtttgtggcaaccctgcattgagcatgtctgtcgatgccatttttccaatagtgtgtgctcacttcttgtctctgtgtcacattttggcaattctcaaaatatccaaacttcattattattattatatccattatggtgatctgtgatcaatgatctttgatgttactgttataattgttttggggtgccatgaattgcacccatataagatgacaaacttaatgtgtgtgttctgacagctccactgacaggccattcccccatctccctctccttggatctgtctacaccctgagacagagtaatattgaaatgaggccaattgataacccaacaatggcctcttagtgtccaagtaaaaggaagtgccacagatctctccctttaaatcaaaagctagaaatgattgagctcagtgaggaaggcacatcaaatctgacatgggctgaaggctaggcctctggcaccagttagccaagtcatgaatgcaaaggaaaagttattgaaggaaattaaaagtgctactccagtgaacacacaaaccataagaaagggaaacagcctgtgttagtcagggttctccagagggacagaactaataggatagatgtatatataaaggggagtttattaaggagtattaactcacacgatcacaaggtaaagtcccacaatagaccatctgcaagctgaggagcaaggaagccagtccgagtcccaaaacctcaaaagtagggaagccgacagtgcagcctttagtctgtggtcgaaggtccaagagtccaaaagctgaagaacttagagtccagtgtttgagggcaggaagcacccagcatgggagaagtaggccagaagactaagccagtctagtcgtccttccacactcttccacctgctttttttttttttttttttttttgagatggagtcttgctctgtcaccaggctggagtgcagtggcgcaatctcggctcactgcaacctctgcctcccaggttcaagcgattcccctgcctcagcctcccgagtagctgggattacaggcatgcactaccatgcccagctaattttttatattttagtagagacggggtttcaccacattggccaggatggtctccatctcctgaccttgtgatccgcccaccttggcctcccaaagtgctgggattacaggtgtgagccaccttcacctgcttttatcctagccatgctggcagctgattagatggtacccacccagattgagggtgggtctgcctcttccagtccactgactcaaatgttaatcttcttggcaacaccctcacagacacacccaggaacaatactttgcatccttcaatccaatccagttgaaactcaatattaaccatcacaagtccacctcttgtcgacttgaacccatacacatctcctgagatcatacataatcttcaaataaagacaaataataaggtcgtaattacgcctatccttcctacaactggaagcataccaatccccaacccaaatgctattacataaagttaacacttaaatgctgatatgacatcaataaatcttatgtcacatgataaaggaaagagaaaggaaatgacaatagtttcttcatccaccatgaaggtggataaggcattccatgggtccacagatggtagtcttggcagaagcattgcatgcaggatagacaaacctatatccagagtaagggtatacatgcacaaacatgttcttaacaaaataaggaagaaatactcatgcaattacagtcctcgtttctgcaactggtcctgtgatcgtagctggtactgatgactcccttcttctactacccattctgtattctctttgccttcagcaaacacctcagcaggtcgttgtcttttacctggtggagtgacccaaagtttcactcctgaagggtctgggccatttgtagtcctgccaggattgggctcttgtagttttccattgaccttaatcacagggcatggtaaaactaagagatgccctaagggatctcctgtattccacgcatactctttcttacctccattgtggagtagtaaactgatttcatcttgatagtctgggtcaatcaccccagtcaacactaactgtcttcttagcctgttgagttagaggtaggaggagcttaaagtgtccagggggcaatctttgttgtatctcctggtggcagcattcctccctctggaactaagacctctaggccagcagaacgtaatgttgcgggaacaggaagcaaaaattttgctaatgggtcactaggggtgatggtgagtggtgccacttccatttccaccccttgattcctggacccgtgaatcctggctgtgggagaaacagtaccatgtataggacgttgattcagaacatacacagccttgtgaagaactttgccccagccttgcaaagtattgttacctaattggcattgtaattgtgacttcaaaaggccattccactgttctatcaatccagctgcttcaagataatggggaatatgttaagaccagtgaattccatgagcatgagcccactgctgcacttctttagccgtaaagtgagtgccttgttcagaggcaatgctatgtggaataccatgaaggtggataaggcattccatgggtctacagacagtagtcttggcagaagcattgcgtgcaggatagacaaacctatatccagagtaagtatctattccagcgagtacaaactgctgcccttttcatgatggaagaggtccagtataatcaacctgccaccaagtagttggctgatcaccttgaggaatggtgcatatcgagggctcagagttggtctctgctgctggcagattgggcactcagcagtggccgtagctaggtcagccttggtgagtggaaatctgtgttgctgagcccatgtgtaacctctatccctgccaccgtggccactttgttcatggacccattgtgcaatgacagaggtggctggggaaagaggctgagtggtgtccacagaacgagtcatcctatccacttgattattaaaatcctcctctactgaggtcacccgttggtgagcattcacatgggatacaaatgtcctcagtttttgaccactcagagaggtccatccacatatctcttccccaaatttctttgtcaccaattttccaatcatgcttcttccaagtccctaaccgtccagccaaaccattggctacagcccatgaatcagtatataatcacatatctgaccatttctccttccaagtaaagcgcataaccaggtgcagtgctcggagttgtgcccactgggaagatttcccttcaccactgtccttcaggaatgtcccagaaaggggctgtagtgccgtagctgtccactttcaggtggtgcctgcatatcatccacagccatctgtaaatcaggccctagtcttctcttcctctgtcaactgatcatagggaaccgcccaccaccacccatgaggccatcggtgcgggctgggggagagaaggcagggtgacagggcatttgagccacttcctcatgtaatttgcttgtgccctcaggacctgctcgagcccgatcatgtatataccatttccacttgatgatagaatgctgctgtgcacaccccactttatggctagataggtcagaaagcacccagttcatgataggcagttcagatcacaaggaatggcttccttgctcctcagcttgcagatggcctattgtgggacttcaccttgtggttgtgagtcagtactccttaataaactcccctttatatatacatctatcctattacttctgtccctctagaagtattttggtaccaggagtagttctagaggaacagaatattaaggatggagttctttcgttggttttggggtttctggagttggcttctcagaagcaaggtcacaactggctcactggctctgtgctgcttctttgaagttgaaaatccttttttttttttttttttttttgagatggagtctcacactgtcacccaggctggagtgcagtggtgcgatctcagctcactgcaacctctgcctccagggttcaagtgattctcctgcctcagcctcccaagtagctgggattacaggggtgcgccaccacgcccggctaatttttgtatgtttcgtagagatggggtttcaccatgttggccaggctggtctcgaattcctgacctcgtgatccgcccaccttggcctcccaaagtgctgggattacaggcatgagccaccgcgcctggccgaaaatctttttttaaaaaacttttattttagtttcaggggcacatgtgcaggtttgttctatagatgaattgtgtgtcacaggccaggcgcggtggctcacacctatagtcccagcactttgagaggccaaggtgggtggatcacaaggtcaggtgtttgagaccagcctggccaacatagtgaaaccccgtctctacaaaaaatacaaaaaattagccaggcgtggtggcacgcacctgtaatcccagctactcgggaggctgaggcaggagaatcgcttgaacccgggaggcggaggttgcagtgagctgagatcgcgccacttccagcccaggcaacagtgcaagactccgtctcaaaaaataaaaaataaaataaattgcctgtcacaggggtttggtgtacatattattttgccacccaggtaataagcatagtacccagtgggtagttttttgattctcaccctcctcccacgctccaccctcaagtaggccccaatatctgttgttcccttcttcacgtgcaagtgtactcattgtttagctcccattaataagtgagaatatacagtgtctggttttctgtttctgcattagttcacttagaataatgtgaagtcgaaaatgttgaagaagattgtgtttctagaactattttatacacacacacacacacacacacacacacacacatatatattttttttgagacggagtcttgctctgtcgcccaggctggagtgcaacggtgcaatctcggcccactgcaacctctgcctcccaggttcaagcgattctcctgcctcagcctcccaaatagctgggactactggtgcgcgccaccacacccacctaattttttgtggggtttttttgtttttgtttttgtttttagtagagatggggtttcaccatgttagccaggatggtctcaatctcctgaccttgtgatatgcctgcctcagcctcccaaagtgctgagattacaggtgtgagcaaccacgcctggccaactattttatattttaaaggacacatcatctgagttttgtaaaagctgtccctgatcaaagggacttggttaaaattccagacttttttatgcagtttaatttagagaaaaaaaatttaatttccactctgtctagaacactagtaggcacatagtaggtgctataaatatttgtggaatgaatgaatgcaggtcactatgcccagtgcctcagagaatccccaaatgagtgagaacagtccctatttcaaggaacctccagcaaggtgcggggagccttgtacacagttgagcacagtacaggccctaatccaaagagccgcccatctgctcaggactctgctcagccatcatcctctccatagccagccaaagctgaattcacccccttctctgtgttgacagagcatcatgtgcagccctctttcattcactcacttaacatccagccctcttctaagggctgaggatgcaaaagtccctaccctcctggagcttatgtgacagtgaacagcatggataagatcaggtggcgataagcactatggaaaaaaaattaaaccggttcagatgacagaggggtggaagggagtagctggataaggtggtcaggaaaggattctctgagaaggtgacattatagcagagccatgcaggaaactagggcataggcggggttggtctatgcctcattgcttggtgttagtattttatacttagcaatctcctgctagactgctatgaggttgggaactgtcttgatttattgttgcacagtaggtgctcagtatgtgtgtgtgttagtctgtttggctgctaaactgactggcttataaacaacagagatgtatttctcacagttccggaggctgggaagtccatgatcaaggtatggccagagtcagtgtcaattgagggcccatttcttgattcatgaacaaccatcttctcagtgtgtcctcacatgatggaaggggcgcaagggagctctctggggtctcttttataagggcactgatgccattcaggaggattccaccttcatgacctaatcacctcccaaaggccccacctcctaataccaccaccatggggttagggtttcaactcacatgttttgaggagacagaaacattcagacatagcagtggtatgggatgcaactaagaagggaaggagaagctggggggcaagggcagggtcacctggcagatagggaaaatgttgagaccaaacctgctcaaggactttgccctttgttcactcctgagctcaaatgacccacctgcccctgcctcccaaagtgctcaggttacaggtgcgagccactgcacctggccagttatatcattctgtttttttttttttttttttttttttttggagacagggtctcactctgtcgcccagtctggagtgcagtggctcagtctctgctcacagcaacctttgcctggcaggttcaagcaattttcctgcctcagcctcccaaatagctgggattacaggcatgcaccaccacgtctggctaatttttgtatatttagtagagacagggtttcactatattggccaggccggttttgaactcctgacctcaagtgatccacccgccttggcctcccaaagtgctgtgattacaggtgtgagccaccgcgcccggccatttatatcattctttataccttacaagttttgtaaatattctcttgcatactcattgttggaaaaacataataaaaaagacttacttgatttttagaatgatgccacacacaaaacaaacccccaccaaaactggtatttttgacattccttctgtgcagaccaagtgtgtgatttttaaaacgcactggaaatgatgtggctttgaaaaggggcttaattagccctatgaactcacccatccagaatcccaggcaggtcatgtgattaatgataccttttcctgtgacctcctaagctctgacagtgcattgttctcctgcctgatgtcagataaactaagccactgttgggtggctgtgcatgttaatagcattgctcttttaagcgttcaagtttatttttattgttttcatcattgggtacttgcatgggttttagaaaactagattcaacaacactctgaaagacatagatggagcatagctttgttcccataacctagagaaaagaaatccagtgtggccaagtggatttgtccagcccatctctacctcttgagtgttgatgctgcctgtacttccaggtcttcagtgtgaaatattctctaatggttttatattcttagaaatatattctaagtcagtttggtcattacgataggtaatatttcagctatctattactgctgttacaaagcccccaaaattgagttgcttaaacagtaatttattattcattttcacagttctgtgacttgggcttactgggaggttctctctttggatcttttgtgcagttgctctgtgggttgacttgggttactcagggtcttccatgccattgcagtccagtgttgactggagctgcagttacctagagctcagatgagctgaaggttcaagatgggccattttcctacctggcagttgatgatggctattggctgggagctcagctgagtctgtcaaaccagagtgcctactatggcttctctgtatggcttaggcttctcacagtgactgggttccaacaagaaatggccccaagattgagcatcttttgggtcaggaagcggaagctgtcaggccagtgaaggactatgctctcaattggcacagccttacttgtctgctgtattttataggtcaaagcagtcgggccaacctagattcaatgggatggagagataaactcaaaagataagatcttgtgggatgggagatattattgtggccaactttggaaaattcagtgtgccaaagataatcacttccagaggtagatcatagctgagatcagttttgtttcagggacctagtttaatttcactttatcatgtgttgaaaacaaaacatattccatatgagggaaaaaattaggataaaggtgtctggatggcccaaaacaagtacctcccactttactccaaatcacaggcccgtggaaggctccctcccagacccaggctatccctttggtggctgaggacatttaatggatcctggccaagtgcccttcccataagcttctctgggagatgtgtggcttggttatcctctcccacagataagcatctacagcacactaggctcccacaagggcgacttaactgctgtttttgccaccacatcattctctagtaggcttttacattcttacctgaaattcttcctgaagagggtaattgaaaatgtcaagtgatgtcccctccttgcagccatatctatatactcactcagtcctgtatttttgagtcttatcagaggatcatttgaatttagaccaattttttcagcttttaaatttcgaaatcatttcaaccttgcaaaagaatcacaagactagaacacagaactctttcttccccaccttttatcctgtattaatgtgtagccacatttctgtcatccttcccatcccctatcaccctcactcagtcttgcacagtctctcacattcatcctccatagatgcacacacagacatacatacccagatttctcccagaaccgtttgagagtaacttgcagacatcatacccctttgcccctaagaacgaagacattattttccattgttatggaaatcagaaagtttaacttggtactgttacttaatttctaatgtatgtgcaacttttgccaggtgtcccagtaagattctgggtttttttgagacagactcttgctctgtggcccatgctggagtgccgtgctgtgatctcggcttactgcaacctccgcctcccaggttcaagtgattctcctgcctcagcctcccgagtagctgggattacaggggcacaccaccatacctggctaatttttgtgtttttattagagatggggtttcaccatgttggccaggctggtctcaaactcctgacctcaagtgatctgcctgcctcgccctctcctttgtactgggagtacaggcatgagccaccaggtctggcccaataagattttttatatcattttttttttcatggtccagggtccaacccagggtcccacattgcatttaattgtctcaccttcttagtcttctttcaactgaaacagttcctcagccattctttttcctgaccttgacattattttattttattttattttattttattttattttattttattttatttttcgagatggtgactccctctgtcactgaggctggagtgcagtggtgcaatctcggctcactgcaacctccgcctcccgggttcaagtgattctcctgcctcagcctcccgagtagctgggactacaggcacatgccaccacacccggctaattttttgtatttttagtagagacggggtttcaccatgttagccaggatggtctcgatctcctgacctcgtgatccacccgcctcagcctcccaaagtgctgggattacaggcgtgagccactgcacccggctgaccttgacatttttaaagaatataggctagtcgtcttgaggactgccttcagtttggataggcctgacgtttcctctgattgcattcaggttgtgttctttgggcaggaatctcgtggcagaggtgttgggtccttctcagtacctcttatcaggaggctatgatgtcagtttgtttaattactggtgatattaactttgattactggattaaggtggtgttcccaggtttctccggtataaaactgctgctctttcttatctaggaagtaacaaacttttctgaatgttggctgagctgtgctgatgaagccaagacccctcccatgcagtgagtgggccgtgttcactcactgtgcatggagtcaagtggttttggagaacatggaactagattccaagattggaggaaaaaagtcttttgggggttccactttgcagtcaactcacattcagaggcatgacaaccctctccagagagttattcttgccactgtgtttacagaggtgtttgttcgtattttctgccagtcatggaacctaaaaggttatatcatactgccttatgttcctagaaggtctagtttaccatcctaaacacaccttgtgaatcccctttgttatatttttattggaccttaaaaaattaaagtggaagagctaaaaaagtgagacaatgaacaaatgccttgagtgccagccctggtactcttgtctgtttgcatttctttgggaaaggttgtttaaactcttaggactttggttttcttctgtaaaatatggttaatagcaatttcctacgtacctcactggattactgtggcaatcaaatagacccttgttaaatagatgagaaggtacttcagaataaacctccatacaagcacagtgagttcccctaattaattcatatttcttaaatcagccaaaatacctatttccaggaaattgaaaaatagcttgccagactttctttggctttcagcaatgtgagcagggctggccagagagccgtgcagtctgacataccagccttgtggtttagtttcttccggatacctgtgcttagcacttttgcagggcagctgacagggtacaaagtccatgtaagcaagtggcaaagcaggatgagcaggaaacttgacagattgtagataacattgggaacttcttttttttaattctgtattttgttcactcactgtaaaaaaaaaaaaaatctatgacttgcccacacttttctaatttgaaggtcatgtttgtgtgtgcatacaagtgtgtgtgttttctaacttactctgtttattgggcaggggctggggtcggggactgtaaacagacttcttaatgagctttatcccaaagaatccacccttacttctcaggtagaagttatttttaaatgtgtgctcatgggtaattggtccagttttatttagaatggaacctcgcagtctgtggcgtgaactgaacctacatgtgaccattctcttaaaacaagcaaggctgttcagggctatgccaacttgaggctgtcagaacctcccccacctaggccaccctggccttttctccctaggattaggatcttgtcctgcatttccatttacttagatgggtctgacatagccaacaggctcctgccacactgactgagtgtgtgagccatttaagcagacacagaggttgtgctggaactcagatgctggctatggctgctgaggctgcagccagttcaggcctcccacccactccccccagtccagccctggagacccttgtggtcggagtcatgtctgcaggaaggcttcttgtctgcctacccattcatgggcagaagtgccagcacacttcagggacccccgaagcagagcccaactctttctatactgcttagagaagcccagagtgtgggctcgcaggccagttccagggagagaacaagaacaggcagggttgtgcacacccagcagctttgctcattctcaccaatcagagaaatcgtacctcattccacggggaggagggtgagggcaagcaagaagatcaggtgagatttgccaggccttccaatgccagaaagtcctcctcaacaggtcaaggtaggaatgcttatgggatgagaaagtgtttccatctgttatcatctaccacgagatagtctttcctacagcctctatcgccaagtttcaaatccactccctgcccttgtactgttgttggatcaaaggacacatatcattcacgtgacaatccagtggagagataatgtgctttgatcttggcaaggcactagaccaagtcttttgagacaccctcgtggtggttgggtggcgggtatacagctctactgtgggcgccactcaccttagataacagcgtgaaaggaagacgtggccaagcaaaagaccaccagctgtatctttatacatattaactgagactaaatgcaggctcagctaatgtgtacagttagtacacattgtgtaactcattggaaaaccatgctcaatggagcactgtcagtgtgagcaagcaggacatgggctcccctgttattacagttcatcttcctggttttggttcattcttgtctgtgaggattatttggatttttagtttatcatctaattgatcaacaccaatacctaacagctattgagtgcctactctatgccagttctataaagaacatcttggggtcttggtgaccccaaactcagacttagctgcgctggcaacacaggaagtagagcagagctgtaagaaggctctgtggcttagttcactgtgggaagccatttcacctctctaagcctagttttctcatctgtaaagaggccatgataatagtacctgtgtcataccatttacacacatatgtacacaaatatgtgtctgtagacatttagcagcctagtggctggtgtgtagacagcactcagtaaacatggacacaactgcagagagtgtgaatggaggtctgagctccaaatggccagggtaaggacctggtctgactgtgtcagaacacatgaggactcaacgtgctgaatcgtagaggcactcacacattacctctcaagccaaggctctcaggagcctcaaggtcaccatggggattggacactacccctccaagcagaacagctccactcttacctactgggtacagacagagtgtgtgtgcatctgtctctgtctctgtctgtctctgtctctctctctctctctctctctctctctctctccccccgccttctctctccctctctccctctctttctctctccctctctccctctctttctctctccctctctccctccccgccctaccccatgtctcagggattctcagttgagggagatcttgtccctaaggggacgtttagcaatgtctgaaggcatttttggttgtcataacctgcgtggggagcggactgctgctggcatctagtgaatggaggccagggatgctgctaaacatcccacagtgcccaggacaaccccacaacaaagcactatccagccccaaatgtcagtgatgccaggttgaggaagcctgctctgcgggcgtatatgtatggcggggcagggggattctctgcatggcttttatttggtaaaagtctaggaaaaaatagaagatcagcgttatatagtgtacctggaaaaaaccacctgattgctaagcactctgaaaaaccacatcccttaggagaacccgagtgtggggcctgagcccaaggccagaggggagaatagtctgcagagagtcgaagcaccatccacaaagacaaggtgtcttgggagttctgagttgctccaggcctaatggcatgaggacacagggaagccacttggccaatatgaaagtccacatgccacttgaggattcttttctccttcaagaccaagtttaatattgatctgatcatatttccccttattagcaggatctgatttggtaactctaagcctctggtgaaaaatcgtctttgaatatcagggtgatttgccatttttattgctgtttttatagatcaaaaaagtcagatattagcaattcatggttcaacctgctgaggattgagggtgatgacttgtaatttctgtatacattactttatatccttcctagaggaactctgtacaaatgcccacatccctgttcaaacctctagggaaactgggcatctcaagctaagctgttacccctgtcctgaacaagcagcactcaccaggagcccagcctaggctggcgtacctgtaacggaccctttcccagcagacataagacgagctcctgtgttttaaccaagtggcttgtcctcaccttttgcatctgcccagttgggagaagagagattcttttaaacctgagaccctccaaaaaacaccccccatccccatctcttggctgtgttccttggcatttaaaaagaaatggggaaccttgaagacttgctaagtaaaataagccagacataaaaggacaaatactgtgtcattccatttatacgagtcacctggaagaggcacattcacagagacaggaagtagaagggtgattgccaggggctgaggggaggggaatggagagttgaacgccactgaactgtacacttaaaaatggttaaaatggtaaatttggtgttatatatgttttgtcacaatttttttaaaaggagccagcatgttcattgccatatgctgaaaccagattcaaccctgatgttcacctaaaaagagggagtagggaagtgcctaatactccatctttacattgtcatgaaacctaagtgagattaggacatggcatcatcagctgggcttcttaaaatgtttccctttccaccagggccgtcttagagagaccgtatattcctgttgggctgagagcactttagtgacttttgagtgtgtgctaagccctattttccttcctctggaaggatgaaattgttcagcttgttggaactaggtgtcttaggaacagagagctctgtgttcaggcccagtaatcatcctctggcatattttttgttttccaggacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcaggtagatgctgccaccgtgccttggctttcccaagacggttctcctcagacccaatccacgtgccattctctcatgttttggggagggaaagggatttttctctggggacaagtgcatcccctcgtgcagctttcttgggtttgcacgttgctcctgagttctttccttcagtcttctgagggtcccctggaggaaatctagaggctgactccactcatggctgtggaagctcacggggatgctgagtaaaacaggcctgcatctgcacctcacgcaaaagaagatcttcctttagactttcaggcttctatgatgcagtgagttcacccagatggtggctgctgtggcacttgctagtgaccttgtctttcctcctcatgtttctattgtcttccactgtaaaatgcgtccagggttccagccagcccatgacagcttctcttgcttggtggtcgattgtgctagtctggacggcatttcccatcaccacactgggttggattttttttcacttccaactggcagctgctgtgtgagtggaatcattatattcgtttcccttgatcttttcctcttgatgcctctcctctggtgcagccttggggaagcccacagcaggcaccactgatgcaggagaggctgcgaagatcttggctgaaaagagaagacaggcccggctgcagaaggaacaggaggagcaagaacgactggagaaggaagaacaagataggtatgctagtgctcagaatttcggtgtgatctcatgtaactgttgtgttggaaagagcagcttgcctttctttttacagcgttggtattgataaaacttgaacagaagtatgggaacctagaatgtctgaactacatggaaggtgttcaggagactgagtcttatattagatgtaattattaataacaatggaactttgttcttttcggaggacctggaaactcatagctcttggatctaaatggcacaggcatcttcccattctcctcttggactttggggccaggcaggcctcctagagctatcagggaagtctgaactttgtttaaaaaatgagattctccctgggaaaacaagaggttcaagattctggttttggtcttgattctgatttccaaattgtttcctccgtcaaattatcctaactcacaccccaaagtgagagacagaggggagggttgagcagtgtcccctaggcatagggttgtgtgtaggggcaaccgcatagtctaagaacagtgaggtatggggagtcccatctgggagcaagacaaaagacatcattgcagtggtccctacaccttgaagagcatcagaatcatccggggaatgcagtaaaaacacatggactcagccctgttctgttttagtagcttgccagggtttgagaaccactgtgatgttagtaccagggtactttgtcacaatacagacagaccttccttttctgatctttttatttagagaggaaagcatgttgaaggacaaggtcgattttatcattaaattgataaaggaagccgttaggctcatcacagagtacaatccaatactgtttagagaattatcatgacaggaagcaggcaatgctgtagcacttcaaggccagcaccgaatttagagtaataaataatagaatattattgatcctttagtgaccttggtaagtctttgtggtctctgattacaggtttgctgatctattttttaaaagggacagtggggtaggtctcgacagtcccttcttgaaatttgggacttctttgattgttttcctgtttccaacattttggtcaatacagacgtgttttgtttgtttgtttgtttgttttgtcgagtggcatgtttgggctggtttgggtgggccttaaggtgtgtgaagggaggtcacaagagataaagatgaatcacaggacctcagatgacaggccttgataattgcaggccatggagataccatgtaggctctgagctggtgagtaacatgatcgtagtcgtgtgctaaagaaggtgatgttctttactttccagctaccaccgtctgtatctcccattttcttcacagcccagctcctgaaagacttgattgaacattctgtctttattttctcaactcacattcagtcttcaaacctcacacctaccactcctcctcgttgcctaactactaatcagtttcttggttggctttggccttgtcaagcttgcccttgcttctctggcctctccttcatagcctcctctgtctgcccctcatccccttaaatgttgcctgggctttcagcccttagtcctggaccagcttctctcccaacaagctctcccgaacagcactgctcccgcctgttctgccagtgtccctgccatcctgccagtttcctatggcgtcaaaagatttagggcccacattttacacaacagctttctgttgagcctttgttgtgctaaaccagctctgctctcatctcacttcccaccttcattttccctttgtcttgttttattgtccgtttctgaagctaactgcagcttgctttctaaaccttccatactttctggaacaagggaggcactaataacacatgtgtactgatgactcctaaaactatgcctgtggcccaagctctgtctagggctgcattgtccactatcagaccctctaggcacatgtggccaccaaaatatacattcagtaaaattcatttccccagccacacccgccacatttccgtgctcaagagctgcatctgagtagatgtggatccacaccacattgggcagcacaaatctatagattgttttcctactcaacagaaggttctattggatagcactggtctagaacctagagactgtatttccagctgcaataagttttcgtttgagtgtgtcccatatacatctcaaatccagcatttccaaagcagaacttagtattttttccccaaacttcccttctctttcatgagctctgtgttcccatctcctcagacacccaagtgaaaagtctcagtgctactctcagctctttcctttccttcttcttcccaatggttgtcaggtccagtcttcatcagctgtcacattggcatctctgttctctcccttcccttcccgtccctcctctccttcctcagctccagcccccatcgcttctcacctggactgtatctgttatatcccaactgagctccctgctctaggtctcctagagtttgtcccctgtccacgctgggcccacactgacctttctcaaataaatgtgattgttctcctgtcctttaacaagccagtgactcccctgcccactggatccacccgaacctgtcaacaggccttcaaggcctgccgtgaactgaccactacctgcctcttactccttgctttcctccagacaccagtgtgcaaagctccctgacattcacccatcacacggctccacacctccaaagctgtgcttttactttgcccccacgtggacttgtgctccttcctgccagacacctcttcatttctcaaaatgcaggtcaagtcttgctccctccctgtaccttttctggccctgtgcctgggacagaactgaccaccccccactcttcacccatactgagcccagctgttcagttgactaacatagcttcatttgtttacaggcctcctttccccagttagcaccttaaaaggctgggacatagtctttggatcactggtgcctggcgctcagtaaatgtacaagaaaggaacagaaggaggaagaatcctgactaagaaaccatcgtagtagtaggttaagagaacagaagggctaaagtagtatggtgaaggcagacatgcaaaagccagtctctgtggacttacacaatgccaaagaaatgggcagatttgaagttgatgctgaggtttgattctaaggtcttaggagaatggtacacccaataacaggtaaagaaaggacataaggaattggttttaaaagataaaaattattcatttgattttaggtgaggttatggtgtctacagtacgtccagatgattggagatggaattgaaggttgggggtgtaggtaaaaattagagcaatacactcgaccccaaatgagttttcctctctcttgccagaatgtgaagctttgcatagtgccacgtgggaggtgaggagtgaggaaggaaagtaccagacaacctggggctggaacacagcggccacctcttggaataagatcatcctcacatctgttttatgtttacagttaatagttaaagccacagaaatgttgccagataaaataatttagagaaaaataaagttacttgagtcaaaccgtggaaagcccaattattgtcacaaactggtaagggaaacaccatccaagtcaaggatgggggaaccagaacagaagggccaaccaggagtccagacaagcaggccctaagcagaagaacaaaagttggtccattcccaaacacaacagggcccagcccccaggctgtggatggcccaagatataaagtgagattcttagaggtggggcaggaaaccttagacgccgggtccaccctggggaaggcactggcaggaactagtaagcaggagatcttaatgggattcctagacggatcactttaagtcatgttaaaaagctaaaatagctactaggggttcacatgaaagaatattccagccagacgcaatggcttgtacctgtagtcccagctacttgaaaggctgaggtgggaggatcactagaggccaggagttcgagttgagcctgggcaacgtagagagaccccatctttttaaaaaattgaaggaaagagaatattccagttagacagctccctacgagcaaggtcacgtaggcaggctaaagtttcttgtcgaagcaagagttagcccaggccaggaaccacaggcagaggtcttcgaggctgctcagacctggctttttgctgctgagcctacaggtggcaggtggttttggtgagagctagggcaggtgggggcacatgcgatgtggggcagcaggatgtagcagcagctgaggcaggaagggaaagccaagagaggtaggagagagccagggtcatgcagccttatgtagcacagggctgtagggagagccacatgggcaggacttttgataagacataggcttatcaaagacgaaggctgttggtcttgggatttaggagatgaaaagagattttggagggaaattgttgagaagtaggatagagacaaagcagcctgaagagatgagtggatacaggcccagaatataagctggctgttaagcagtcatgaatgagaagcagctgagagaggactgaggagggttgcttgtgattcccgagacatgagcatttttccagggcatggaaaacatgcatgcagaaggttgaaactgacaaatgaagggaagaggggctagtgggagggacacatagctgtggaggatgtggaattcacagcacaagtggtggcatttccatctaagcagaggaacaaatggggacatttctgagcagtaatgtcatagaggagagtttaagaagctcagatcaggtggcctcagtcttctctgtatagcagttggtgataagcatcaactaaggaagatgacgaagattgagaaaagtggtaattgggactgtgtccataagggatccaggggatgaggattaaaaggccggaatgcaattgccagcaggcagataaccagccagcctcgtttacacctctctctaaccagtgattggcagcccaggagtggtcctggaaaccacccaagcctggagttgggcagcagagtgacctccatgccatctctgaaatgctcacaagggtacctaaggcctggggaacactgagagagagggaagcagacgcaagtagactgcacagcgctaaccagggcaggtcaggagagaaaaaggcagaaggatggggtgtgatcagatcaaagaagattaatgttgaaggttaggcttgttttaaaatgaaaacttttaagcacgtaagaatagagaccagtgaaacccacatactcgtccctcagattgaacaattcaagtttaagtttgtgtcagtgacatgaggaaggttaacagggagcgacagaaaagggggcgaggtgctggagtttccaacagacaggagccaatatatgaagatcctcctcaaatggccagtgacagggacaagggatgatgcatccactgaatgccaaatgatgacagtaatgcacagttttctggtactttgtacatagtgaggaaagggagagggacttgggtgaatgacaagaacaaggatggagagggtgacaggactacacacagggccaggcactggctcacacctgtaatcccagtgctttgggagaatggggtgggcggatcacttgagcccaggagtttgagaccagcctgggcaacaaaatgagacctgtctctattaaaaaaaaattcaaaaatgatccaggcatggtggcactcacccgtggtcctggctacttgggagctgaggtgggaggatcgcttgagcctgagaggttggggctgcagtaagctgtgatggcagcactgcactccaacttgggcaacagcacgaaaccctgcctctacaaagaaaaaaaaaaaaggactacacacagagctgatgaactttggaggtttagtaatgacggcaagggcggtaggctcggggtagcccacggcagagggcggtggggaaaatgatgaaatctaatgtgctgtctggttctttgagcagagacagaaggaatgctcatcctcggagaggattgtgagggacctggtttcacacaggggaagccagggttgtttgttttgttgaattttacctactttagggaagcaaagtgtggttaagggagagaacttggtatataagaggatgaaggggctgggcacagtggctcaaacctgtaatcccagcactttgggaggccaaggcaggcagatcacttgaggtcaggagttcgagaccagcctggccaacatggtgaaaccccatctctactaaaactacaaaaattagctgggcatagcggcgcatgcctgtagtcccggctacttgggaggctgaggcacaagaatcacttgaacccaggaggcagaggttgtagtgagccaagatcacaccactgtactccagcctgggcaacagagtgagactccatctcaaaaaaaaaaaaaaaaaaaaggacaagatttccctggaggtgctatggaaaggacaagcggggtctcatgggcttgtggggatttatattttgggtgataatgaggattatggaggttcaggggccataaggatgttcttacatgtgtgcatctgggcacttctgaagtcctgatggtaaaaaacaagaaacagaggccaagtgcagcggctcatgcctataatcctagcactttgggaggccgaggcaggcagatcacctgaggtcaggagtttgagaccagcctgaccaacatggtgaaaccccgtctctactaaaaatacaaaattagccagacatggtggcgcatacctgtaatcccagctagttgggaggctgaggcaggagaatcacttgcacctgggaggcagaggttgtggtgagccaaggttgcaccattgcactccaacctgggcaacaacagtgaaacgccatcaaaaaaaaaaaaaaaaaaaagagaatggattttcaggtcctggagatgaagacggcaggtcctttatgaagtagcttatacattaattaatacacaatgtatcctttgtgtgttaacttctctgggacaatcataattggctcgttaataaagggtaagaaatgaaatggtacttcagttaacctttagatacatcttgttattaacacatccattttggataatcctgtgttggacatagtatttcattgaggaatctaagaaaatgggagcttctttctgataggttctataatgctcctctccagaatatctgttaataatttgagttgtttcacaatggtttataggcattgtgacctaatttagtgttatcacgtattgttacagtctcaggctaatatatttaagtatttgtttatctttcttttaaaatatttctttgaatgaataaacaaaatatttcctttggtcatacataggctgttagcctgcacaagttctgaagctgaccattaggatggatggatgctctttttaagtcttgacctttttataacaacagcatcccagtaagtcattggcacatgcttccaaatgaaggtaatttctaaaggacatacagatttataggtgcactttaaaggacattggggcttggagagaggattcattttaaattgtaaaacaaactaacgtttgagaaccttctagggccaggcattttcattctcacagtaaagccatagaacaatagtatagcttttcccattttttaaatgggcatcaagaacattgagtgactttccaggtgtcacacagtgagtggcataatcagagtacaatttgagtcatgcccatacatcacattgccagtgattacccaaggaaagtgacgtacatgtgaggaggaggaacattagaaaggttaaaacaagctcttggactttacaggattttcccttactgcttcgagctctttaccattacaccatgaaccattcatctgactgtggatgaaaatgtctaaatgccacttaattttcatatagcaaagaaagctaaaatagatttctaaagattgccaaaataaatggaaatagaggttttaatttattaaatgtcaagtttctgttgagcattttcttccatttgctgcttcataagtcacataccaattagaaccaaattggtatgactttttgagttcgtagtcactgctcttaaattgctgactggcacatttgtggccattgagacacttcccatttttcctagctttcattggttttaaatattctgcttaggttttaaaagaattgtcattcaataagaatgatggcttggctttctgtcaccgtggtcatttgttcattgactgaggagcatctgttttcaatacagtatgcgttacacatcaacacatcattcattgctgtattacagaatttaaagtcaagcctggttaatactttttggtaaatatatggaccagagtggatttccaggaaggatgaatcatgttattaaatgaatgctcgttgaaaggtatgtgtgtgtgttaccatgtggagcattattctcggctgtcagcacacagttctctggcagtttgcttttcgagcatgtcatcttctaacaacagttgtattctcaaaaggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcaggtactgtatgagtcctcagatggactttacttgttttttaaggaccttgatagtaggtacaattagttaaatttcaatgactcataatgtttacttgaagtttcttcttaaactgtctgggctggttattaaatataagttggggcagttgcagtgaagttggtaatgtttgccatctgtgagttagggtttccccaaaggcaaaccctgggctaagaatttgagtgccagcagttttttttgcaagcgaatcccaggaagctggtagaggaataggagaaaagccaatgtaagtgcattgatgcatgtgttactgtgggtgactggaacacagtcccattgggaacctctgacagactgtggatcatgctttagaattgtccagctgagggatgaggaaactgaactacttatctaccacatcctgcccttcacggtagtagaaggtcactccctggggaattaactctctgatctggccacatgcacacttcatggcccaagcctgcccacagacacagaaaagccttggccatgtgtgagaactgtctgcaggtgatttgcatggtgagccaggggtatatgaatgaggtccaaccatgtttgctgtgtcatgcagtggtttgtataaatccacattgaatattggagcagcatccactttagggcagatgatgagatgaaggaacatgtgcaaagccagggaattaccacactgttttcttagcttattaaagctttgccttgatttacctgtttctgttagaaagaagcagcagaaacaaaggcccgggaggtagctgaacagatgcgtctcgagagagaacagattatgctgcagattgagcaggagagactggagagaaagaaggtaagggctgagggtcaggaagacctagggtaagtgaacaggaagtaaatccagttctcttctgcagtgattggatagaatgatcctaggattgtcagttaggtcaagttcattgataccactgttcaaatcttttatgtctttattagttttttgccatctcgttccatcagtgattgagaaagattgttaaaaactccatctgtagcgaggcatggtggctcacacctgtaatcccagcatttagggaggcagaggcgggaggatcacttgagcccagaagttccagaccagcttgagtaatacagtgaaaccctgtctctactaaaaatacaaaaaatagctgggtgtgatggcatgtgtctgtagtcccagctacgtaggaggttgaggtgggaagatgacctgaactcgggaagttaagcctgcagtgagccgagatcatgccactgcagtccagcctggggaacaggagtgagaccctgtcccaaataatagaaaaaagaataactccatctgtgattatggatttgtccatttttcctttcagttctgtcaggttttgttttatatatatttatcgtgatatgcctttgtctctagtgatatttcttgtcttaaagtctactttgacagccccctgccttttatttttttgagacagtctcactctattgcccatgctggagtgcagtggtgtgatctcggctcaccacaacctccacctcccaggttcaagcgattctcctgcctcagcctcccaactagctgggattacaggcgcacaccaccacacctggctaatttttgtatttttagtagagatgggatttcaccatgttggccaggctggtctcgaactcctggactcaagggatcctcctgcctcggccttccaaagtgctgggattatagacgtgagccactgtgcttggcctgacagcccttttatgattagtgtctgtatgtcaaatctttttcacccttctacttaaaacttcttctgtgtgtttttataagtaaagagcatatagccaggaattgttattttaattctgtttgacagtctttgtcttttaattggagtgtttagtccatttacactaactatacttatgggtaaaattgggtttaagcagactgattataaaggagtattctcatggtgtcctaggcccaacctgggctttgtattgctgtaggcctgggatccaggagaccagcctgtggccttctctcctgagatgcacctcagcctcagcctcactttctgtagggtggtgctctttaatggcaggtggtaatttgttgatttatacagagcctaaggagaagaaggagaaatatgggatataaatcgaatattgattctagatacgtactagttaacttctcaagcatttgaccttgtccatggggccggaggtgtacatctccaaaactagtggaaaacctttctatacttgttatcctcttctgacttttgccttttacaagttttctgagaaatgtgacattgcatgtaaaccaagctacttttatgtttttggtcttattgtcctcttacttgattttgttttttgttttttgtttttagagaatagatgaaatcatgaagagaacaaggaaaagtgatgtgtctccacaagtgaaggtaggaattcaaatgaccattttaatagtttatgtactaagtagaaaagaacagcagaatacactcagtgaaattgtaggtcttggcgacgattagccagaaaaaaatgcagttttcctgctttgttcctggctaggttaaggagggttaggtacctgaaaagaaagaggggcttcagaggtgggatgggtaagagatttccttagagtcatgggaggtgggatgaagagagaggcatagtagtccatgaataaaaaagagaatcctgacataaaaatacgtaagaataagggaaacacagctgaagatttaaagaattaccacagaacaggcagatggtccaggctcaaaatatcatcggatgcttttaaaaagtactttttttctgtgtgatgtcagccttccctcatttcattcaccttccatttgttttcagaaagaagaccccaaagtgggggtccagcctgctgtgtgtgtggaaaagaagacaaaactggttgtccccaacaaaatgggtgagtgtgacatctggttcttgggttcttccttttagtagcaaaagctcgtaagacttggtgtagggtaaacagacccatggatcccaagagggtgactgctggcaggggcctgtgcagtttcccttccctgggaatgtgtctccagcacagggactgtcagctccacttgggaacccactgggttccttggttactcccataatcccagcataggaggcactctggctgctggctcacagtgctttccagggagcttaactgctggtcaggttttattactgttaggacctgactctgctcttctccagaggttctgcacagacactgataatgtgatttgtcttctcttctcctgtgtgaaggtgattatatgggtttatttgtggctctttccacaaaagatgctgcagtatcagtgaagcagagcattaaattaattgccttgatctatatttctctgttactttatttagacattttatgattaacacaagggactttgtgttctcgatcagaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgaggtatattcatttcttttgcatttaagcctcatcacttctcgaaacactaccctttcttttagttggtttcttcgtcttttatacaaccaaatcacctaaagcaggtttgattgacattacaggaaagctctcagtggtataacattctagtgtcttgcgtcaggttccctagaagcagagcctggaacagagtttctagggcatgtgatttgttagaggaaagctcttgggagtttttcaggagaaaggggaaggagggaattcgctaagcaaggatgccttctcagctgaccccatgggagctctggaggatgaatttccaccagagacagttcctctgagcttctgcagttctggtttttctagattcttctctaagatctcacaaggaagaaaaagaagaacctggcagcagctttactctggctgttaagagattcctggtgacaggccctcagcccaccactcttcagagcctggatttgttcctttgctaggccttacagctggcgcaattatgaaactcctccttccatctctagggagaggaagagagagagagaaagaaaaccagccttggctgggctggagctggataagtcagagtggattggaagcctcactttagagaggaagcagagcgtgagattggctttgccagtgatgacgtgggctgtggtgggatcctttcattatgggccccccaaccttaactgagcacttcaggcgtttccacatgaactcttctcagcacgatcagattcacactcacaggagccctggcagagagaaacaattgttcccattttactggcgaagaaactgaggctgcaggaaggaaaagcaattcgcccaaggtggcactactagaaaggcagcactgggagccccactgttaattagggttcttcttcaacttgctttgaacttttggcattggctttctgtctgaatgtcccatttagaaagttctggaatgccttgcttctttgtggtagaatgctggtgcctgtgggtttttgtcctttcaccctttgggcaatgtgaccttggccatcacagccctgctcaatctgcttccctgttctcatacatggggcctcgtgtccaccatctgtcctcctcagatttgagcccacttgtattttttacagtgtgttacacaaaaactctgactctaaatccttcttctttagaagagtagtaaaacaaaatattgcaaatagaattaatatattgtgccatgttgtctgtctgtctctttctgcctctctccctctcgttcatctcttctagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtacagtcttttgattatattctaacttcataaccctttaactggggtttgtgaagataggatgtatatcactcagcctcttggatggtcaaattttatttgaaaaacgcaaacatgaatatattatggtatactacaacacacacaagaattgagacagatttcaattaattcatctgcgagccttcagcgccgagccgccttgtcctaaccctgctatttagggtgtgtagatgggaaagttgagaacactggctaaaggtttgactaccagtccagcctgagtagcttttttagggggcaaggaaagaatactctagtagtgttgcaaggtgatatgaataagatgaatttccccacctctagttttgctcagtgacatcccacattctatctagaatcattcatatacagggccacaggatttgctattctcttgacccattctggattcttccaaagcagacagctattcttggatcatacctgagggagagagaactgcagtttttgtgtcttgaaggttttttccccacctttggcctttttttatttttgccaaagtgcttccagaagctattctcatttgagcaagaatgtctatgagttatatacactctgtagtaaggtatacttagttacatatacctcacattttatttacttcagtttggggcttgtttttgaataaggaaaacataattagagtctgtcaccaaatcctttaataatttaataattccaattgctcctcccacttcagattctgtttttgttttcaagagaagtgatctcactctgttgtccaggctggtgtgcagtggcgcaatcacagctcactgagacttcaaactcctgggctcaggagatccccttgcctcagcctcctgagtagttggatcataggcacatgccaccaggcccagctaattttttttagtttttgtagaggttgggtcttgctatgttgcccggctggtcttgaacccctggcctcaagtgatcctctctccttggcctcccaagtacttactgggattacagccatgagctaccatgccttgcatccatttatccattttagattctttttttttttttttttttttttttgagatggaatctcactctgtcacccaggctggagtgcagtggcatgatctccactcacagccacttctacctcccaggttcaagccattctcctgcctcagcctcccgagtagctgggactacaggtgcacgccgccatgcctggctaattttttgtattttagtagagacagggtttcactgtgttgcccaagctggtctcgaactcctgagctcaggtaatctgcctgccttggcttcccaaagtgctaggattacaggcgtgagccaccgcgcccggccattttagattcttaaaagcatttttatattctcggcattttctcagtcactttattttttatacttcactcccataacaaattcactggccaaaataacagtccagtgtttttatttttcaaatgaggaaacaggtgggagaggctacagagctgaggtcactgtgttttttgtatacttgtttctacctgacctcagctcttgcctataagacaagtttgagagcccatttctcttggttcttggtgtgtggtgggtcacttttagagtaaactgtatcactggtttggaaaagcagctgccttcttggacacttaaaacactaaatcacctgagcattctatttccctgacagttacgtggcttaatatttattaagaggttttttgtgtttttaacatactttgactttaaaattagtttcccttcagttcacttacctcactatacagtaaggaacagagaatccacaaaatttattagagtattcataggtcctcaaatttatttcttacatctctaaaagaaatgcaaaacccctgtccaaaaagaaaaatctcaaattattttattcacactgcttgtatatttttaattatgattgggtctagttctcaaattcttctctaccaaaagtggtaccacccccaccaggagacgtttggacatacgttgatggtttttgttgccagagtggctgggggcatttgaaagacaaagcttgagacattaaatatctgcaggttttagaaaagttccatacaaggaaaatttgacccatctaaaagaatagtcctatgtaaaatactctatcacttctgttgagaaatactgtataagcccaggaggaaaatataattgccaagaaggtagaaagtgccacagtgtgttgtgatcgttttagtgagagaatagtgctacaaactgcacaatacttggttttccctttgatctcatctggttttgtttctgaattgacacaggtgtttggagaacccgtaaagctgctgatagtcaaatccgagctactagctgcttgaagaagcttctgtcaccctt

SEQ ID NO: 3283 - DNA, 49906 bp, human
gatgatgcgccggtccctggagcgcacacagcagctggagctgaaaaagaagtattcgtggggagcaccactggccattggacccggaggacatgatggtgagtgtagggttgcccctgtatttcaggtcctgggtgggaaataatggagcaggcaggggattatgggcaccactgggtgtctccaggatctgggggatgctttgcacagcttttcagaggcaccactttcagatgtgatgtttaaaactgccaagattcctacgcatgcatttgttatgaaggggatctgtgcattcttcttgatagcaaacagcagttgacacaaaaactgggttttgagggagagcaaaagagaagactttgaacgcagagcccagtgagctgggcccagctggcaagcccagggttgttctgacttcaggggagggaaacggcaggaggctctgtcactggtccagatgcgatcaggaaaagcacagtggcagttatcctccaaaaagggctggactatttcctgctgcattttaaatttttgttgctttttcgactttgtttcaaggtgacttatttcattaccagttcaaactcatctttaaattttcaaatgtgtaatttaatatatggattgttactagtctctggatggcttttccttcttttcagtgtctcactacatttcagcgatcttagcattctattatgcaggaggtgtgtactagctctatctgagagcaaatggatttgtgtttacaggacagttcttgactttgctgtattgtgcttttcacctttgggcagtaaatatactttattttttcttttttgaaaagtcaacaacccatttcagttactttttctaatttcctaattagaaactaagaagcaacaagaaattgggacttttttcttttacctctctttgctctgattttttgctgtgtaggtgaatcagaaaataccccaccccctcctctaggtttagcagccagcaccctccctccggatgcagggaccactgccgcagctgccgagtccaccaacggtatatccgagcatcactgtgccatagcattttgtgataactgttctgatcatcctcccccatcaccatgtctgcgtcaagcacttttacaattggtttcttagtctggcctgtcacaatttttttttcctagcaatgtgaatgacatgcccatatttctttgttcctctgtcattatagagcggtgcatgccttacatcttagtgccccggagacatttcatcctcaactcactaacgtctgccttgaaaatcttgtcagtgttggatttttgcacactcagatctttaacaatctcttcatcatctgttgtagacattaagaagcagggcatttctgattacttctggttaccaaaacctgtaatcacccggagttctgaatggagaacttgggcttagtgttaaagtgatagattcctggagaggtgtttgagagggagtggtaggaattttatcagtgctaacactggtaatccaaataattagataatttggctttgtgcttgattttatttaataggctgtctgttttgtatacaggcctgggaaactcctctggtctagatcaagaacagaactagccaaactttgtttccatttaataatgactttagaaattcaatccatcttcaactggcaaagaaaaaaaaaaaaagctgtaaaagggatgcaatatttaccaacaatgcggaaggtcatattagcagtaggaatcaatatccttggtttctgacattcctttgacaatgaataatccttactgggggtgcttcgtaacagcagttttgctgcacaagcagagttacctctagtgtgggcactggctttccccctaagaaaggtgcaggggggctgggcgtggtggcttgtgcctgtaatcccagcactttgggaggctgaggcaggcggattgcttgatgtcagtagttcgagaccagcctggccaacatggtaaaaccccgcctctactaaaaatacaaaaattagtcaagtgtggtggcgggtgcctggagccccagctactcaggaggctgaggcaagagaattgcttgaacccgggaggcagaggttgcagtgagatcgtaccagtgccctccagcctgggcaacggagcaagactctgtcttgaaaaaaaaagaaaaaagaaaggtgcagagaggtggagtaatcacccactgggaatcagcacccagggcccgggccagggtgaaatgagtgcagtacttgactagagcatacaatttaagggagtgccaaaaatctcagtaataaagataaaataatatcttaatgtgatattttttaaaatccaaattaatgcaaaacaatccataataaacaacaaatttctaaagactggtgccatgctgagcacatcagagcctgaagcaaaagggaaaatgtgtactcctatatacgtggttttatgtaatttctaatgtttagttttatcaaaacattaaagtagtttaaaatatggaaaaattgaaaagagtattaaaactcatataatttcaactttaaatagttttatttctacacaaatcaaatttattgtacttttacttcagctttagttaattaaaaattaccgggccaggtgcagtggctcacgcctgtaatcccagcactttgggaggctgaggcagatcacgaggtcaagagatcgagaccatcctggccaacatggtgaaacactgtctctactaaaaatacaaaaattagctgggcgtggtggcatgcacctgtagtcccagctactcaggaggttgaggcaggagaatcacttgaacccgggaggcggaggttgcagtgagccgagatcgtgccactgcactctagcctgggagacagagcaagactctgtctcaaaaaaaaaattatttaagattgtcatttggtcagcagaaattatagaacatcgcagttcttatggcagttctcatgggaaaacacgatgagcagaggagtagattttgaaaatattattgatgagtttgcttttttacaaccaagagcacacatttttcttttggcctcaggctctaacttagcttggcagggcactgtcagcatctctttgtttgccgtctgaaataatgactggaacgtaagaacaccaaactcagggtcgcctgttaaaatgctaacctcaaacagttaaagcatttgcaaaaggaccattttgatctgtctcttactaagtaagaaaaggaaaaccaactgctaaagaggccgttctgctttaaatacaactctgagaggacggatttcatctctctccaacctgagctacagataaccttcataaaagagtcggtttcagcaagcggtgacagtcagaccatagggcgttttccagtggtgatttgtctctgggtccaagttggttttgtttttgtgtgatgtgagcatgctcaaaaatccctagacaaaagaaaatgatttgttggtgggattaacacggcttcagttgaacagttgagtgaggttgaacatttgaaattgaagatgacaacacagtgaagaagttgcagagattttgctgcagaccaagggctgctgtagcctggtcatttctagagtaggataatgagatgccaggatgatgaaagcagagcatgctgtgccacagcatttaggaggtgcgtggatgaggacaggaaggacacttcgggatatgtgtttcttggttctacagtagtgtgatgaataccaatgtctttaatgcatttctctgcagcatgtgacaaactttcaacatcaactatgagtttgccaaagccaacggagcctcccatgaataaacgcctgtcttcatccaccgtggcaatatcctattccccagaccgaggcaagtgaacatgtagacttggtctctctagtttgtttcttttctggtgtgagcatcttaacgtttgtctttgtgagagtctcctcttgagccttctgcagataccgtcattgtcctagtcttgtggtctgaatgtgggagctctagggccttgtcagtgggactttggaacgtggcacggctctttagagccaggtcgttgttgaatagaggtaggaattaatgcagtctcccagtctgaaagagactgttctgttttccacattgcatgtaggagttatcctgcccaggaattaattaaccagtgggcagatgtgaccattaaagtaactgcctggtcaatgatggaatacagttgattagccagaaagagcagaattgataagttatagttatatgggaggcttagatatgtgaaaaaatggggttctgcagtcatctgtggtttataggcctgcccattttgtagatgaaaagagaagcacagaactaatgaggcctctaaaagaggaaaaggttgggtggcgctctgttttgagttaggagatgatgtgtatgggacgtgtgccagttccagaacctgagtagatttaacagggtctgcattctcacaaaggctcagataagtcactgaaagtctgtttatacctttcagagtatacaggttaaggaaatgacggaagctctccatgcactaaatgtttattctaaagcaacattgaagaagtatcaggtgccagtggagtgtttagcacaagttatcaccaagggcagagcaaaaggctggttgcgacttggcagaggctggtgtgccttcctggttgtttccactgacattgaccttgtacctctatcccagaggcatattatgtgtgtcagagaccctataaggttcataatgctactgatctgtgatgcagttcatggtaagcaccaggaacctggaagtgatgaagagctgaatacagagtgagggaaaagttaattcattgccatatataatacattcaaaactgatctaaatattttggtcattgacttccagattatgaatactactatttgtctttcattaaagctgataatcagttggctgtttgtatttttgtgcctctcacttaatttttacccttattgacatgtaaaaagtatgaaaagatatatttttatactattacaagatgacattttatttaaaaatcagtgtgttatgaaatgcttcttagcgcaggacctaaaacaagtgttttataggcataatttgttttctacttggagtaaaggtttttttgttgttgttttttttgttttttttttgtttgttttttttttgagacaggctctctgttgcacaggctagagtgcagtgatacagtcttggctcactgcaaactctgcctcccgggctcaagccatcctctcacttcagcctcaagtagctgggactacaggcgcatgtcaccatgcccagctaatttttttgtattttttgtagagacgaggtttcgccacgttgcccagggtggtctcaaattcttgagttcaagtgacccgactgccttggcctcccaaagtgctgggataacaagcatgagccaccatgcctggccataaatgatttcctgagtccatattacatctgggaggtgggctaattctctgagtgatacaggttactgtactgcaatagcatattgaatggattttggtacctagtgacaattaatgcactctcccaaactctaaaggacacattatttgttttattttacgatgacaaattccaaatccatcctttgttcaaatatttttattttccatgttctgccacccaaaagttaatttgcaccatgcattgtgttgtttaaatgttttattttgttttgttttaattttgctttttaaaattttcatttgattccatccctcagctcatcacatgcaccttagtccaatggaagccattcttgtttcgcgactgttgacacccacacagtcttctttagccagaagcagagcttcagtcatgctctctgggcaggccaatgattcaggtaaaagaggctaagctggtaacaccaaggaaaatgcccgaagaggtgttggtcagcctaggatttactcctgaatttttggattttgcttcctatttgctggctttgtgaaaagtcttcattggttaataacgtcttataccagtgttttgctgttttatgtttcttttgagtgtcacagaggtgagtaaattatcttatgagtgagagcatgttctttaggggaagaaaaccccacttgatgaactctggaggttagtagacttttcttaagagacggtgtggcaaaacagcctgtagaccagtctggggtgtcccatagccagctctaccactcactagctctcaccattgggggtaagttaattaacttctttaagcctcagttttctcatctataagatggagctattttaaattattttgaagattaaatgagagagtgcatgcaaatgagatagcacaatgattagcacagaatgaaagctagaaactttgagaagtttctagcctcactactcaaaaggtggtccatggaccagcaatggcagcagcatctaggagcttggttggaaggccccacctagcctgcacactgaagtctgagaaacactggaccagaccatcaaagccctgcctttatcaaagcagatcaagtcgtcatgtcaggatttgtggcggctggcattctctttgtttccagatgagcagcactgtgtccacctaaggtcaggtctactctctgttctccagatagtgtactcagttgtgatgatacataaatgagataaaacttctgcctagttgtagctgcttccaaacagttatactgtttctgcaaataagttgtacagatagctaataggttcataagatgctcaacatcattaatcattagggaaatgcaaatcaaaaccatagtgggatgccactttacacccactaggatgactagaatttttttaaaaggggaaataaccacgtgttggtggaggtgtggagacactcttccctcacacactgctggtgggaatgtaaaatgatgcagctactgtagaacacagtctgaccgttgctcaaaaacttaagcatagagttcccatacgacccagcaattccactcctaggtatacagccaaggaaattaaaaacatatgtttgcacaaaaacttattcacaatagccacaaagtggaaagaaaatatgatatacccataaagtagaatattattcagctataaaaagaaatacaggccaggcatggtggctcacacctgtaatctcagcactatgggaggccaaggtgggcagttcacttgaggtagggagttcgagaccagcatggccaacatagtgaaaccccatctctactaaaaatacaaaaattagctgggtgtggtggtgcacacctgtaatcccagctactcgggaggctaagacaggagaatcacttgagcccaggaggtggagactgtagtgagccgagattgcaccactgtactccagcttgggtgacacagcgagactccatctcaaaaaaaaaaaaaaaaaaatacagatacatgccacaagatggatgaaccttgaaaatgtgctaagtgaaagaaaccagttgcaaaaggccacatattgtgtgcttctatttatgtgaaatgtctgaaataggaaaatccatggagatggacaatagatggtggttatcagagactggaggagggaaggaaggggagtgactgcttaacggacgaagtttctttggggaatcttgaaaatgtttttagaagtagactgtggttatggttccacaaccttgcaaatgtagcaaaacctccaaattgtatgtgtatatgtatacgtatacatatacgtatacatatatgtatatatatgtatatgtatttaaagacagggtcttgctcttttaccctggctagaatgcagtgatgtgatcatagctcactgcagcctcgaactccaagccctcctctcacctcagcttcccaagtagctgggactacaggcacacaccaccatgcctggctaattttttgggttctttggagggacaaggtctcactatgttgctcaggctggtctcaaactcttgggctcaagcgcgacccatctactttggcctcccaaagttctaggattacaggtatgagccaccatgcctgtcctgtatactttttaaagggtgaattttatggtatatgaattatgtatcaaaaaaccctagcaagtaggaagtaccccattttgagaataaggaatatgttggggttccctaagagcaactccaggatcagtgatttgctaggaagactcacaggatccccagtgaaaggatgcaagcaaagtcagcaaaggagaaagacacatgggacaaagtcctgggaagaccaggcacaagcttgcagagtcctctctggtggagtcactcaggacgcctttcaccccagcaatgagttacgacaacatgtatgaaatgttgccaaccagggaagctttttagagactcagtgccaacggtttttacagagggctggtcacatgtactccatgcccagcacatacccaaattccaggttcccagaaggaaagcaggtattcaacatacaccatgttgtttgtttatgccctgtgagccactcaacagttaaagggggatcgtcctaaaatgtacgttcccaggtgctggctaaaggctaaccttgtaagcaggccttagtagggacagcagtcaggcttgctatgttaactcatttttgcacagctcacccacttgacccttggccaaggtgtctttacagaaaatttttcagtagggccccacatagcagggggtgagaccatcctgcagtattgatctcagttatgtcctttaggggttctgggacttagcagttaaagcaaatctcattaaccagaaggtctgtcttttttttctctctttcttttctttttctttttcttatttatttatttatttatttattttggagacaaggtcttgctctgttgctcttagccacgctggagtgcagtggcatgatcatggctcactgtggcctcaacctcctaggcttaagtgatcatcccacctaagtctcctgagtagctaggactataggtgtgtgctaccacacttagctaattttttttttttttttttgtagagatagggtcttcctatgttgcccaagttggtctcaaactctgggactcaagcgatcctcccacctcggcctcccaaagtgctgggattacaggcttaagccactgcacctggccttagaaaggtctgtttgaggcagccaggtggcctcctccatcagttgctgtatgaatctttttacctggcctgtggcatcagctcaggcccagaacagctctggccagtaagttgaaactgatctgaatgccttccaggcctgacgccgtgtcatgataatcgtggcacgcacataggaactatgatccccaagggctcatgtggttccctggaaaaaaagagttgaagatgttagggcacactagcagggtatcattggtcagtcagttcccagtgtggcctcccactgtggtgactggtgcctcagggtgctcagtccagtgcaggtaattcagctcagtcccaggttttatggcggctgcctgaggccatcagtcccaaacagttctaccagtgaccctacttcatcttcctggcaagtgcagatggcatctggagctgttctgtggggacatgtaggaactggccccactcctgccggctcatagtcatgctgtcacatgccatctaggctcagccatgggtctgagtccaaggtgctttcagcacaaggagttttccttcaggaaggagagcgcttccaggagcagttatggaaaacagaacacaaatgtccttccgtatccctgtatcatttttaccccaggtgttggattatgttgtttttctccatgtcctattcaataatcaaaactttacattttcttaatcatcccctactctcacccagacctttcaaagaaaggacaaaagcatttcttaaaacccatttttatccaacttaaccagaaagatatattgtgttcaggtattaggctaaaatcctaagttttcgaaacattttaaagtaggtttgtatcacctctgagccctttcatcttgatcattttatccagtgagcagcctagaaaagatcaatccctttccagtgacagctgcatttaacaaattgctttactgacgtgtgtagtgagagaaaggtagaggaaatatagtcaggatctcagtctattacaaactgcagctactccagaaaattaaacacaaagcatcaacagcagtgacactttccccagagggaatggagttcagtctgtcagggatggctgaaagagtcacattgcctgtggtgtgacttggagcttttgtaggaatcatgtgttgggaatataatcagactctgcatcagaaataatagagccaatgagcagcttgattgtggatggtcccatcagagaacaagccctgtcttgtgggcacttgtatgtgacccagtctagcagcatccagaatctttttacagttttgggccccatgaagggcattctatatttgtagtggtccctactcgatttttaaaactccagaagcatgtcttttcctagaaattgcctgtcttttcatatctccccttttcaagaggctccattagacaaaagtcatagcagaaaaatctactacagagacttgttctggttctaatatttggagtttaaattccagcctacccactgctggcaaaaagcaaggaggttgtgtctaactctcacttggaggagaaaacaaaaaccaaaggcatcacttgggctgtgctttttccctcactttagctagcatgctacagtcaaaagcagccagggggatccatcaagccaactctcttggagctgtattggtcatctttaaattccgtaggtcacttttacctctcaaaacagctcagctgctgttttataccatggataacttcatagccacccaggcatcacaagtttgttctccacccttttgtccttttcccaaaatgtgattttaccacgtttcagcaaatcagggtcattccagcaattcccatttctgacactagttgtgccagagttccccaagaccaccccaggtttgatgattggctaggagaacttggaagaatcagcatagttccacgcatggctgtgacttattttttctttcttagctttttttttttttttttttttttttcgagatggggtctttctctgtcacccaggttggagtgtagtggcgcgatcttgactcactgcagcctcaactttccaggctcaagcgatcctcctgcctcagcctccagagtagttgggactacaggagtgtgcccccatgccaagctaatttttgtattttttgaagggctgtggtttcaccatgttgccaaggctggtctcaacctcctaagctcaggtgagccaccatgcccggcccatggctatgatttattatagcaggaggaaacatgaaaaaactagcaaatggaggaggtgcatgggactaagttcagaagtaaccaggtgtggatttccaagagtcttcttccagtggagtcacatgggacgagcttaattcctctaccaacacattgtgacaacatgtatgaaatgttgccaggctgggaagttggctagaaactcagtgcccagggtttttactgggggctagatatgtaggcatcccctcccaggcacatacccagattccacactcccacaagaaaagcagatgcttagcataaaccatactgtttgtataaacagtttagacacccatcagttaatggtgggaaccctcctgaaatctaagttctcagatgccagccaagggccacccttataagcaggcctttccaagcacagcagtcagatctgctatgttaacccttttgtgcacaaggaaatcgatgtttagagaggttaagtaacctgcccaaggtgatccagctattaggtggcagtgctaggtctctgtggctccaaagtacagacttttaacccctgaaataaacttgaataaacttgactcttgagtatgggagcctttttagggtaagatccatcctgtgtacaatagaaaagtatgatattgattgcccaggtcatattttaacagaaatgtgttcttcccaactctctgctctactttttccatctgtactctctgtccttctggctgttatactgtaactttctagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtaggtttaaaaccacccacccactcactcctctagactgtgttctgtctgatggtgtgattacttctgtgcttgacctgggctgtctgtttccatcaatctcctgggactgctcaaagcaggaaagggtagatttagttcaaaattttacccaacctttgaaaatcatttaactttttgcaccctcttaagtcttagtaccttggagcaaattcttaatgatgtccttgtcacagcctgccctccagaggacaggagtcagaaggaatgttctaaatatcctctgtcttcctcgttacggatatctgattctgggtcagtcttgcccgtgcatctaagtggaactgaggatctacgtcaacttttacctacaaaagtaatcattaaatattcttttgagatgaagtctttttatgttgcccaggctgaccttgaattcctaggctcaagtaatcctcctgcctcagcctcctgagtagctgggactacaggcacatgttactatgccaagcttaaacatttttgatggcatactggcactatcagtaaattaaatgttgagaaggcacccccaattgtgtctatttatttagaaattacacagtgccatactacttttgttagttattgattgctacttaacaaatcacctcaaaccttggcagcttaaaataacaaatatctattaattcatgggttctttgggtcagaaattcagagtgacttagtggttctggtacaaggtctttcatgaggtgtggtcaagatgttggccagggctgcatcatctgaaagcatggctgggcctcatctgagacggctcattcatggctgttggcaggaggcctcggttcctcactgcatgggcctgtccataaagctgcttgagtatccaaatgatgccacagctggcttccctccaagcaagctatcgggaagctgcagtgtcctttaagtaagtcactaagatcaacccacactcaagaggagaggaattaagcctcacctgtcgaagggaggaatatcaaataatgtcaggacttatttcaaaactacttcattttataatgccatattttcttttcaaatctgttgtggctcttagaagtgcatgttttagactctcggattttactatacagtggattagtgttgaaagggattgatggatgtgagtgtgggggccaattgaggacttgctgcagaaaagtgtgatagggagagaagggagctaacccttgtggagcactttctgcaggctgggcactgatgtctgttcccttctgccaaaggaggtaatgggaagacctacaggactagatggggttgcagacccattataccatgtataccatcaggggccacagctcactgtcttggatgttgtaaccacattttcacccacctgtaatttttttgtagtgattttacatttttatactcttttcagttcctatatgtctaagaccgtaatatggttcagttgttaactctttgaaagacaacaaggagaaggaaatctttgcattttgaggctgattttttttaactggataatgcaaatgtgatgacctcatcctgcctccccgcaaagatgcctgtcatgtgaagcgttatagcttcatatcgatccctctgaaagaaagctgtgcattgttccatctggggtattagtcttataaattgtggaagtagtgccagtcatggactgtggctatcctgtgtcccctacaggtggagaaggtgaagcgggggcaacgaacagcaacttctcttcctgttgtgaacttcgggtcccctctgagaagatgtgagttttctggaggcattcctaagagaccatcttctcctgtgatatccaagtaagcatctctcccctttgccagacagtctgactgtcatgagtcagtttgctagggctttgtgccatccagtgttgcagctcctgctcccccgtgaggcgtggccagccagaagtggtaagtgggagaaatgctggccttggagttacgtggcttgactctctgtgtatcttctgggtgaaagatcctttgctaagggaccccagtgcgtaacagggcttttatttaccaagatgatgcattcagcattttctctttaggtccatgaattccattctgcttttctggtattctttttccagttgcatttggatttaagtgattgcattgggcttgggctcctcctgacattctcccccaccttgttgtctctctctttaatagagagacaataataacttgtcagccatgatcaacagtattttaatgaagcaaatatatatgtgtgtgtgtttttaagaaatggggtcttgttgggttgcccaggcctggagtacagtgactgttcacaggcataatcacagcacgctatagcctccaactcctgggctcaagtgatccccccgcctcagactcccaagtagctgggaccactatgcccatgcaccataacaccaccatgcctaatttttgttaggaactaggtaaactcaccaaggaaaccatgtaactgaaaaatttacaataactttgtgaccaccaaggtcttaagtcattaaaatattttactgacagtaactgacaaaagactcagtaaataactcagtccagtaggacagtggaaaccatctttagtaggacagagaaagaaagagaaatatgatttaatttgggaatataggaaagtttttatatggagagaatcatataaaccttattcagtgtatcagtttagttcagagaatgttggataaacacaagtttaatgaaaacttgcgaatttgtcaaaaatatttaaagatgacatcagctcttaaatttccaatgtgttgctttctaatagagactttttcactactattaataattttttttagagatcactatggttttgatacactactaatacctgccattgatgtgtttgtcctccataaggaaaatctttccatagcacatcactgaattaaaagcctacttttctttctttctttatttttagttcattgcaacctttctgtgctagtattgcccatctttggttatggtgttgttatcctaccacctctttaaatttattatgtggactctacgatccgtttccctctgtcttatatctgagcctttttcagcttccacccatgcatcattactctggtgttaattttggacatttgcattaacagaaagaaaagcctagtttacgctgagacttttacaggctccaccctctctctgtcttgctggaatttggactcatggtccctgcagggatactagcttgcaagtttcatcattattattgtaaatggtagtatcttctatagaaatgagaattataggtatacctagttttgttgtactttgcacttcgcaaatactggttttttttgttgttgttgttgtttgttttacaaattgaaggtttgtggcaaccctgcattgagcatgtctgtcgatgccatttttccaatagtgtgtgctcacttcttgtctctgtgtcacattttggcaattctcaaaatatccaaacttcattattattattatatccattatggtgatctgtgatcaatgatctttgatgttactgttataattgttttggggtgccatgaattgcacccatataagatgacaaacttaatgtgtgtgttctgacagctccactgacaggccattcccccatctccctctccttggatctgtctacaccctgagacagagtaatattgaaatgaggccaattgataacccaacaatggcctcttagtgtccaagtaaaaggaagtgccacagatctctccctttaaatcaaaagctagaaatgattgagctcagtgaggaaggcacatcaaatctgacatgggctgaaggctaggcctctggcaccagttagccaagtcatgaatgcaaaggaaaagttattgaaggaaattaaaagtgctactccagtgaacacacaaaccataagaaagggaaacagcctgtgttagtcagggttctccagagggacagaactaataggatagatgtatatataaaggggagtttattaaggagtattaactcacacgatcacaaggtaaagtcccacaatagaccatctgcaagctgaggagcaaggaagccagtccgagtcccaaaacctcaaaagtagggaagccgacagtgcagcctttagtctgtggtcgaaggtccaagagtccaaaagctgaagaacttagagtccagtgtttgagggcaggaagcacccagcatgggagaagtaggccagaagactaagccagtctagtcgtccttccacactcttccacctgctttttttttttttttttttttttgagatggagtcttgctctgtcaccaggctggagtgcagtggcgcaatctcggctcactgcaacctctgcctcccaggttcaagcgattcccctgcctcagcctcccgagtagctgggattacaggcatgcactaccatgcccagctaattttttatattttagtagagacggggtttcaccacattggccaggatggtctccatctcctgaccttgtgatccgcccaccttggcctcccaaagtgctgggattacaggtgtgagccaccttcacctgcttttatcctagccatgctggcagctgattagatggtacccacccagattgagggtgggtctgcctcttccagtccactgactcaaatgttaatcttcttggcaacaccctcacagacacacccaggaacaatactttgcatccttcaatccaatccagttgaaactcaatattaaccatcacaagtccacctcttgtcgacttgaacccatacacatctcctgagatcatacataatcttcaaataaagacaaataataaggtcgtaattacgcctatccttcctacaactggaagcataccaatccccaacccaaatgctattacataaagttaacacttaaatgctgatatgacatcaataaatcttatgtcacatgataaaggaaagagaaaggaaatgacaatagtttcttcatccaccatgaaggtggataaggcattccatgggtccacagatggtagtcttggcagaagcattgcatgcaggatagacaaacctatatccagagtaagggtatacatgcacaaacatgttcttaacaaaataaggaagaaatactcatgcaattacagtcctcgtttctgcaactggtcctgtgatcgtagctggtactgatgactcccttcttctactacccattctgtattctctttgccttcagcaaacacctcagcaggtcgttgtcttttacctggtggagtgacccaaagtttcactcctgaagggtctgggccatttgtagtcctgccaggattgggctcttgtagttttccattgaccttaatcacagggcatggtaaaactaagagatgccctaagggatctcctgtattccacgcatactctttcttacctccattgtggagtagtaaactgatttcatcttgatagtctgggtcaatcaccccagtcaacactaactgtcttcttagcctgttgagttagaggtaggaggagcttaaagtgtccagggggcaatctttgttgtatctcctggtggcagcattcctccctctggaactaagacctctaggccagcagaacgtaatgttgcgggaacaggaagcaaaaattttgctaatgggtcactaggggtgatggtgagtggtgccacttccatttccaccccttgattcctggacccgtgaatcctggctgtgggagaaacagtaccatgtataggacgttgattcagaacatacacagccttgtgaagaactttgccccagccttgcaaagtattgttacctaattggcattgtaattgtgacttcaaaaggccattccactgttctatcaatccagctgcttcaagataatggggaatatgttaagaccagtgaattccatgagcatgagcccactgctgcacttctttagccgtaaagtgagtgccttgttcagaggcaatgctatgtggaataccatgaaggtggataaggcattccatgggtctacagacagtagtcttggcagaagcattgcgtgcaggatagacaaacctatatccagagtaagtatctattccagcgagtacaaactgctgcccttttcatgatggaagaggtccagtataatcaacctgccaccaagtagttggctgatcaccttgaggaatggtgcatatcgagggctcagagttggtctctgctgctggcagattgggcactcagcagtggccgtagctaggtcagccttggtgagtggaaatctgtgttgctgagcccatgtgtaacctctatccctgccaccgtggccactttgttcatggacccattgtgcaatgacagaggtggctggggaaagaggctgagtggtgtccacagaacgagtcatcctatccacttgattattaaaatcctcctctactgaggtcacccgttggtgagcattcacatgggatacaaatgtcctcagtttttgaccactcagagaggtccatccacatatctcttccccaaatttctttgtcaccaattttccaatcatgcttcttccaagtccctaaccgtccagccaaaccattggctacagcccatgaatcagtatataatcacatatctgaccatttctccttccaagtaaagcgcataaccaggtgcagtgctcggagttgtgcccactgggaagatttcccttcaccactgtccttcaggaatgtcccagaaaggggctgtagtgccgtagctgtccactttcaggtggtgcctgcatatcatccacagccatctgtaaatcaggccctagtcttctcttcctctgtcaactgatcatagggaaccgcccaccaccacccatgaggccatcggtgcgggctgggggagagaaggcagggtgacagggcatttgagccacttcctcatgtaatttgcttgtgccctcaggacctgctcgagcccgatcatgtatataccatttccacttgatgatagaatgctgctgtgcacaccccactttatggctagataggtcagaaagcacccagttcatgataggcagttcagatcacaaggaatggcttccttgctcctcagcttgcagatggcctattgtgggacttcaccttgtggttgtgagtcagtactccttaataaactcccctttatatatacatctatcctattacttctgtccctctagaagtattttggtaccaggagtagttctagaggaacagaatattaaggatggagttctttcgttggttttggggtttctggagttggcttctcagaagcaaggtcacaactggctcactggctctgtgctgcttctttgaagttgaaaatccttttttttttttttttttttttgagatggagtctcacactgtcacccaggctggagtgcagtggtgcgatctcagctcactgcaacctctgcctccagggttcaagtgattctcctgcctcagcctcccaagtagctgggattacaggggtgcgccaccacgcccggctaatttttgtatgtttcgtagagatggggtttcaccatgttggccaggctggtctcgaattcctgacctcgtgatccgcccaccttggcctcccaaagtgctgggattacaggcatgagccaccgcgcctggccgaaaatctttttttaaaaaacttttattttagtttcaggggcacatgtgcaggtttgttctatagatgaattgtgtgtcacaggccaggcgcggtggctcacacctatagtcccagcactttgagaggccaaggtgggtggatcacaaggtcaggtgtttgagaccagcctggccaacatagtgaaaccccgtctctacaaaaaatacaaaaaattagccaggcgtggtggcacgcacctgtaatcccagctactcgggaggctgaggcaggagaatcgcttgaacccgggaggcggaggttgcagtgagctgagatcgcgccacttccagcccaggcaacagtgcaagactccgtctcaaaaaataaaaaataaaataaattgcctgtcacaggggtttggtgtacatattattttgccacccaggtaataagcatagtacccagtgggtagttttttgattctcaccctcctcccacgctccaccctcaagtaggccccaatatctgttgttcccttcttcacgtgcaagtgtactcattgtttagctcccattaataagtgagaatatacagtgtctggttttctgtttctgcattagttcacttagaataatgtgaagtcgaaaatgttgaagaagattgtgtttctagaactattttatacacacacacacacacacacacacacacacacatatatattttttttgagacggagtcttgctctgtcgcccaggctggagtgcaacggtgcaatctcggcccactgcaacctctgcctcccaggttcaagcgattctcctgcctcagcctcccaaatagctgggactactggtgcgcgccaccacacccacctaattttttgtggggtttttttgtttttgtttttgtttttagtagagatggggtttcaccatgttagccaggatggtctcaatctcctgaccttgtgatatgcctgcctcagcctcccaaagtgctgagattacaggtgtgagcaaccacgcctggccaactattttatattttaaaggacacatcatctgagttttgtaaaagctgtccctgatcaaagggacttggttaaaattccagacttttttatgcagtttaatttagagaaaaaaaatttaatttccactctgtctagaacactagtaggcacatagtaggtgctataaatatttgtggaatgaatgaatgcaggtcactatgcccagtgcctcagagaatccccaaatgagtgagaacagtccctatttcaaggaacctccagcaaggtgcggggagccttgtacacagttgagcacagtacaggccctaatccaaagagccgcccatctgctcaggactctgctcagccatcatcctctccatagccagccaaagctgaattcacccccttctctgtgttgacagagcatcatgtgcagccctctttcattcactcacttaacatccagccctcttctaagggctgaggatgcaaaagtccctaccctcctggagcttatgtgacagtgaacagcatggataagatcaggtggcgataagcactatggaaaaaaaattaaaccggttcagatgacagaggggtggaagggagtagctggataaggtggtcaggaaaggattctctgagaaggtgacattatagcagagccatgcaggaaactagggcataggcggggttggtctatgcctcattgcttggtgttagtattttatacttagcaatctcctgctagactgctatgaggttgggaactgtcttgatttattgttgcacagtaggtgctcagtatgtgtgtgtgttagtctgtttggctgctaaactgactggcttataaacaacagagatgtatttctcacagttccggaggctgggaagtccatgatcaaggtatggccagagtcagtgtcaattgagggcccatttcttgattcatgaacaaccatcttctcagtgtgtcctcacatgatggaaggggcgcaagggagctctctggggtctcttttataagggcactgatgccattcaggaggattccaccttcatgacctaatcacctcccaaaggccccacctcctaataccaccaccatggggttagggtttcaactcacatgttttgaggagacagaaacattcagacatagcagtggtatgggatgcaactaagaagggaaggagaagctggggggcaagggcagggtcacctggcagatagggaaaatgttgagaccaaacctgctcaaggactttgccctttgttcactcctgagctcaaatgacccacctgcccctgcctcccaaagtgctcaggttacaggtgcgagccactgcacctggccagttatatcattctgtttttttttttttttttttttttttttggagacagggtctcactctgtcgcccagtctggagtgcagtggctcagtctctgctcacagcaacctttgcctggcaggttcaagcaattttcctgcctcagcctcccaaatagctgggattacaggcatgcaccaccacgtctggctaatttttgtatatttagtagagacagggtttcactatattggccaggccggttttgaactcctgacctcaagtgatccacccgccttggcctcccaaagtgctgtgattacaggtgtgagccaccgcgcccggccatttatatcattctttataccttacaagttttgtaaatattctcttgcatactcattgttggaaaaacataataaaaaagacttacttgatttttagaatgatgccacacacaaaacaaacccccaccaaaactggtatttttgacattccttctgtgcagaccaagtgtgtgatttttaaaacgcactggaaatgatgtggctttgaaaaggggcttaattagccctatgaactcacccatccagaatcccaggcaggtcatgtgattaatgataccttttcctgtgacctcctaagctctgacagtgcattgttctcctgcctgatgtcagataaactaagccactgttgggtggctgtgcatgttaatagcattgctcttttaagcgttcaagtttatttttattgttttcatcattgggtacttgcatgggttttagaaaactagattcaacaacactctgaaagacatagatggagcatagctttgttcccataacctagagaaaagaaatccagtgtggccaagtggatttgtccagcccatctctacctcttgagtgttgatgctgcctgtacttccaggtcttcagtgtgaaatattctctaatggttttatattcttagaaatatattctaagtcagtttggtcattacgataggtaatatttcagctatctattactgctgttacaaagcccccaaaattgagttgcttaaacagtaatttattattcattttcacagttctgtgacttgggcttactgggaggttctctctttggatcttttgtgcagttgctctgtgggttgacttgggttactcagggtcttccatgccattgcagtccagtgttgactggagctgcagttacctagagctcagatgagctgaaggttcaagatgggccattttcctacctggcagttgatgatggctattggctgggagctcagctgagtctgtcaaaccagagtgcctactatggcttctctgtatggcttaggcttctcacagtgactgggttccaacaagaaatggccccaagattgagcatcttttgggtcaggaagcggaagctgtcaggccagtgaaggactatgctctcaattggcacagccttacttgtctgctgtattttataggtcaaagcagtcgggccaacctagattcaatgggatggagagataaactcaaaagataagatcttgtgggatgggagatattattgtggccaactttggaaaattcagtgtgccaaagataatcacttccagaggtagatcatagctgagatcagttttgtttcagggacctagtttaatttcactttatcatgtgttgaaaacaaaacatattccatatgagggaaaaaattaggataaaggtgtctggatggcccaaaacaagtacctcccactttactccaaatcacaggcccgtggaaggctccctcccagacccaggctatccctttggtggctgaggacatttaatggatcctggccaagtgcccttcccataagcttctctgggagatgtgtggcttggttatcctctcccacagataagcatctacagcacactaggctcccacaagggcgacttaactgctgtttttgccaccacatcattctctagtaggcttttacattcttacctgaaattcttcctgaagagggtaattgaaaatgtcaagtgatgtcccctccttgcagccatatctatatactcactcagtcctgtatttttgagtcttatcagaggatcatttgaatttagaccaattttttcagcttttaaatttcgaaatcatttcaaccttgcaaaagaatcacaagactagaacacagaactctttcttccccaccttttatcctgtattaatgtgtagccacatttctgtcatccttcccatcccctatcaccctcactcagtcttgcacagtctctcacattcatcctccatagatgcacacacagacatacatacccagatttctcccagaaccgtttgagagtaacttgcagacatcatacccctttgcccctaagaacgaagacattattttccattgttatggaaatcagaaagtttaacttggtactgttacttaatttctaatgtatgtgcaacttttgccaggtgtcccagtaagattctgggtttttttgagacagactcttgctctgtggcccatgctggagtgccgtgctgtgatctcggcttactgcaacctccgcctcccaggttcaagtgattctcctgcctcagcctcccgagtagctgggattacaggggcacaccaccatacctggctaatttttgtgtttttattagagatggggtttcaccatgttggccaggctggtctcaaactcctgacctcaagtgatctgcctgcctcgccctctcctttgtactgggagtacaggcatgagccaccaggtctggcccaataagattttttatatcattttttttttcatggtccagggtccaacccagggtcccacattgcatttaattgtctcaccttcttagtcttctttcaactgaaacagttcctcagccattctttttcctgaccttgacattattttattttattttattttattttattttattttattttattttatttttcgagatggtgactccctctgtcactgaggctggagtgcagtggtgcaatctcggctcactgcaacctccgcctcccgggttcaagtgattctcctgcctcagcctcccgagtagctgggactacaggcacatgccaccacacccggctaattttttgtatttttagtagagacggggtttcaccatgttagccaggatggtctcgatctcctgacctcgtgatccacccgcctcagcctcccaaagtgctgggattacaggcgtgagccactgcacccggctgaccttgacatttttaaagaatataggctagtcgtcttgaggactgccttcagtttggataggcctgacgtttcctctgattgcattcaggttgtgttctttgggcaggaatctcgtggcagaggtgttgggtccttctcagtacctcttatcaggaggctatgatgtcagtttgtttaattactggtgatattaactttgattactggattaaggtggtgttcccaggtttctccggtataaaactgctgctctttcttatctaggaagtaacaaacttttctgaatgttggctgagctgtgctgatgaagccaagacccctcccatgcagtgagtgggccgtgttcactcactgtgcatggagtcaagtggttttggagaacatggaactagattccaagattggaggaaaaaagtcttttgggggttccactttgcagtcaactcacattcagaggcatgacaaccctctccagagagttattcttgccactgtgtttacagaggtgtttgttcgtattttctgccagtcatggaacctaaaaggttatatcatactgccttatgttcctagaaggtctagtttaccatcctaaacacaccttgtgaatcccctttgttatatttttattggaccttaaaaaattaaagtggaagagctaaaaaagtgagacaatgaacaaatgccttgagtgccagccctggtactcttgtctgtttgcatttctttgggaaaggttgtttaaactcttaggactttggttttcttctgtaaaatatggttaatagcaatttcctacgtacctcactggattactgtggcaatcaaatagacccttgttaaatagatgagaaggtacttcagaataaacctccatacaagcacagtgagttcccctaattaattcatatttcttaaatcagccaaaatacctatttccaggaaattgaaaaatagcttgccagactttctttggctttcagcaatgtgagcagggctggccagagagccgtgcagtctgacataccagccttgtggtttagtttcttccggatacctgtgcttagcacttttgcagggcagctgacagggtacaaagtccatgtaagcaagtggcaaagcaggatgagcaggaaacttgacagattgtagataacattgggaacttcttttttttaattctgtattttgttcactcactgtaaaaaaaaaaaaaatctatgacttgcccacacttttctaatttgaaggtcatgtttgtgtgtgcatacaagtgtgtgtgttttctaacttactctgtttattgggcaggggctggggtcggggactgtaaacagacttcttaatgagctttatcccaaagaatccacccttacttctcaggtagaagttatttttaaatgtgtgctcatgggtaattggtccagttttatttagaatggaacctcgcagtctgtggcgtgaactgaacctacatgtgaccattctcttaaaacaagcaaggctgttcagggctatgccaacttgaggctgtcagaacctcccccacctaggccaccctggccttttctccctaggattaggatcttgtcctgcatttccatttacttagatgggtctgacatagccaacaggctcctgccacactgactgagtgtgtgagccatttaagcagacacagaggttgtgctggaactcagatgctggctatggctgctgaggctgcagccagttcaggcctcccacccactccccccagtccagccctggagacccttgtggtcggagtcatgtctgcaggaaggcttcttgtctgcctacccattcatgggcagaagtgccagcacacttcagggacccccgaagcagagcccaactctttctatactgcttagagaagcccagagtgtgggctcgcaggccagttccagggagagaacaagaacaggcagggttgtgcacacccagcagctttgctcattctcaccaatcagagaaatcgtacctcattccacggggaggagggtgagggcaagcaagaagatcaggtgagatttgccaggccttccaatgccagaaagtcctcctcaacaggtcaaggtaggaatgcttatgggatgagaaagtgtttccatctgttatcatctaccacgagatagtctttcctacagcctctatcgccaagtttcaaatccactccctgcccttgtactgttgttggatcaaaggacacatatcattcacgtgacaatccagtggagagataatgtgctttgatcttggcaaggcactagaccaagtcttttgagacaccctcgtggtggttgggtggcgggtatacagctctactgtgggcgccactcaccttagataacagcgtgaaaggaagacgtggccaagcaaaagaccaccagctgtatctttatacatattaactgagactaaatgcaggctcagctaatgtgtacagttagtacacattgtgtaactcattggaaaaccatgctcaatggagcactgtcagtgtgagcaagcaggacatgggctcccctgttattacagttcatcttcctggttttggttcattcttgtctgtgaggattatttggatttttagtttatcatctaattgatcaacaccaatacctaacagctattgagtgcctactctatgccagttctataaagaacatcttggggtcttggtgaccccaaactcagacttagctgcgctggcaacacaggaagtagagcagagctgtaagaaggctctgtggcttagttcactgtgggaagccatttcacctctctaagcctagttttctcatctgtaaagaggccatgataatagtacctgtgtcataccatttacacacatatgtacacaaatatgtgtctgtagacatttagcagcctagtggctggtgtgtagacagcactcagtaaacatggacacaactgcagagagtgtgaatggaggtctgagctccaaatggccagggtaaggacctggtctgactgtgtcagaacacatgaggactcaacgtgctgaatcgtagaggcactcacacattacctctcaagccaaggctctcaggagcctcaaggtcaccatggggattggacactacccctccaagcagaacagctccactcttacctactgggtacagacagagtgtgtgtgcatctgtctctgtctctgtctgtctctgtctctctctctctctctctctctctctctctctccccccgccttctctctccctctctccctctctttctctctccctctctccctctctttctctctccctctctccctccccgccctaccccatgtctcagggattctcagttgagggagatcttgtccctaaggggacgtttagcaatgtctgaaggcatttttggttgtcataacctgcgtggggagcggactgctgctggcatctagtgaatggaggccagggatgctgctaaacatcccacagtgcccaggacaaccccacaacaaagcactatccagccccaaatgtcagtgatgccaggttgaggaagcctgctctgcgggcgtatatgtatggcggggcagggggattctctgcatggcttttatttggtaaaagtctaggaaaaaatagaagatcagcgttatatagtgtacctggaaaaaaccacctgattgctaagcactctgaaaaaccacatcccttaggagaacccgagtgtggggcctgagcccaaggccagaggggagaatagtctgcagagagtcgaagcaccatccacaaagacaaggtgtcttgggagttctgagttgctccaggcctaatggcatgaggacacagggaagccacttggccaatatgaaagtccacatgccacttgaggattcttttctccttcaagaccaagtttaatattgatctgatcatatttccccttattagcaggatctgatttggtaactctaagcctctggtgaaaaatcgtctttgaatatcagggtgatttgccatttttattgctgtttttatagatcaaaaaagtcagatattagcaattcatggttcaacctgctgaggattgagggtgatgacttgtaatttctgtatacattactttatatccttcctagaggaactctgtacaaatgcccacatccctgttcaaacctctagggaaactgggcatctcaagctaagctgttacccctgtcctgaacaagcagcactcaccaggagcccagcctaggctggcgtacctgtaacggaccctttcccagcagacataagacgagctcctgtgttttaaccaagtggcttgtcctcaccttttgcatctgcccagttgggagaagagagattcttttaaacctgagaccctccaaaaaacaccccccatccccatctcttggctgtgttccttggcatttaaaaagaaatggggaaccttgaagacttgctaagtaaaataagccagacataaaaggacaaatactgtgtcattccatttatacgagtcacctggaagaggcacattcacagagacaggaagtagaagggtgattgccaggggctgaggggaggggaatggagagttgaacgccactgaactgtacacttaaaaatggttaaaatggtaaatttggtgttatatatgttttgtcacaatttttttaaaaggagccagcatgttcattgccatatgctgaaaccagattcaaccctgatgttcacctaaaaagagggagtagggaagtgcctaatactccatctttacattgtcatgaaacctaagtgagattaggacatggcatcatcagctgggcttcttaaaatgtttccctttccaccagggccgtcttagagagaccgtatattcctgttgggctgagagcactttagtgacttttgagtgtgtgctaagccctattttccttcctctggaaggatgaaattgttcagcttgttggaactaggtgtcttaggaacagagagctctgtgttcaggcccagtaatcatcctctggcatattttttgttttccaggacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcaggtagatgctgccaccgtgccttggctttcccaagacggttctcctcagacccaatccacgtgccattctctcatgttttggggagggaaagggatttttctctggggacaagtgcatcccctcgtgcagctttcttgggtttgcacgttgctcctgagttctttccttcagtcttctgagggtcccctggaggaaatctagaggctgactccactcatggctgtggaagctcacggggatgctgagtaaaacaggcctgcatctgcacctcacgcaaaagaagatcttcctttagactttcaggcttctatgatgcagtgagttcacccagatggtggctgctgtggcacttgctagtgaccttgtctttcctcctcatgtttctattgtcttccactgtaaaatgcgtccagggttccagccagcccatgacagcttctcttgcttggtggtcgattgtgctagtctggacggcatttcccatcaccacactgggttggattttttttcacttccaactggcagctgctgtgtgagtggaatcattatattcgtttcccttgatcttttcctcttgatgcctctcctctggtgcagccttggggaagcccacagcaggcaccactgatgcaggagaggctgcgaagatcttggctgaaaagagaagacaggcccggctgcagaaggaacaggaggagcaagaacgactggagaaggaagaacaagataggtatgctagtgctcagaatttcggtgtgatctcatgtaactgttgtgttggaaagagcagcttgcctttctttttacagcgttggtattgataaaacttgaacagaagtatgggaacctagaatgtctgaactacatggaaggtgttcaggagactgagtcttatattagatgtaattattaataacaatggaactttgttcttttcggaggacctggaaactcatagctcttggatctaaatggcacaggcatcttcccattctcctcttggactttggggccaggcaggcctcctagagctatcagggaagtctgaactttgtttaaaaaatgagattctccctgggaaaacaagaggttcaagattctggttttggtcttgattctgatttccaaattgtttcctccgtcaaattatcctaactcacaccccaaagtgagagacagaggggagggttgagcagtgtcccctaggcatagggttgtgtgtaggggcaaccgcatagtctaagaacagtgaggtatggggagtcccatctgggagcaagacaaaagacatcattgcagtggtccctacaccttgaagagcatcagaatcatccggggaatgcagtaaaaacacatggactcagccctgttctgttttagtagcttgccagggtttgagaaccactgtgatgttagtaccagggtactttgtcacaatacagacagaccttccttttctgatctttttatttagagaggaaagcatgttgaaggacaaggtcgattttatcattaaattgataaaggaagccgttaggctcatcacagagtacaatccaatactgtttagagaattatcatgacaggaagcaggcaatgctgtagcacttcaaggccagcaccgaatttagagtaataaataatagaatattattgatcctttagtgaccttggtaagtctttgtggtctctgattacaggtttgctgatctattttttaaaagggacagtggggtaggtctcgacagtcccttcttgaaatttgggacttctttgattgttttcctgtttccaacattttggtcaatacagacgtgttttgtttgtttgtttgtttgttttgtcgagtggcatgtttgggctggtttgggtgggccttaaggtgtgtgaagggaggtcacaagagataaagatgaatcacaggacctcagatgacaggccttgataattgcaggccatggagataccatgtaggctctgagctggtgagtaacatgatcgtagtcgtgtgctaaagaaggtgatgttctttactttccagctaccaccgtctgtatctcccattttcttcacagcccagctcctgaaagacttgattgaacattctgtctttattttctcaactcacattcagtcttcaaacctcacacctaccactcctcctcgttgcctaactactaatcagtttcttggttggctttggccttgtcaagcttgcccttgcttctctggcctctccttcatagcctcctctgtctgcccctcatccccttaaatgttgcctgggctttcagcccttagtcctggaccagcttctctcccaacaagctctcccgaacagcactgctcccgcctgttctgccagtgtccctgccatcctgccagtttcctatggcgtcaaaagatttagggcccacattttacacaacagctttctgttgagcctttgttgtgctaaaccagctctgctctcatctcacttcccaccttcattttccctttgtcttgttttattgtccgtttctgaagctaactgcagcttgctttctaaaccttccatactttctggaacaagggaggcactaataacacatgtgtactgatgactcctaaaactatgcctgtggcccaagctctgtctagggctgcattgtccactatcagaccctctaggcacatgtggccaccaaaatatacattcagtaaaattcatttccccagccacacccgccacatttccgtgctcaagagctgcatctgagtagatgtggatccacaccacattgggcagcacaaatctatagattgttttcctactcaacagaaggttctattggatagcactggtctagaacctagagactgtatttccagctgcaataagttttcgtttgagtgtgtcccatatacatctcaaatccagcatttccaaagcagaacttagtattttttccccaaacttcccttctctttcatgagctctgtgttcccatctcctcagacacccaagtgaaaagtctcagtgctactctcagctctttcctttccttcttcttcccaatggttgtcaggtccagtcttcatcagctgtcacattggcatctctgttctctcccttcccttcccgtccctcctctccttcctcagctccagcccccatcgcttctcacctggactgtatctgttatatcccaactgagctccctgctctaggtctcctagagtttgtcccctgtccacgctgggcccacactgacctttctcaaataaatgtgattgttctcctgtcctttaacaagccagtgactcccctgcccactggatccacccgaacctgtcaacaggccttcaaggcctgccgtgaactgaccactacctgcctcttactccttgctttcctccagacaccagtgtgcaaagctccctgacattcacccatcacacggctccacacctccaaagctgtgcttttactttgcccccacgtggacttgtgctccttcctgccagacacctcttcatttctcaaaatgcaggtcaagtcttgctccctccctgtaccttttctggccctgtgcctgggacagaactgaccaccccccactcttcacccatactgagcccagctgttcagttgactaacatagcttcatttgtttacaggcctcctttccccagttagcaccttaaaaggctgggacatagtctttggatcactggtgcctggcgctcagtaaatgtacaagaaaggaacagaaggaggaagaatcctgactaagaaaccatcgtagtagtaggttaagagaacagaagggctaaagtagtatggtgaaggcagacatgcaaaagccagtctctgtggacttacacaatgccaaagaaatgggcagatttgaagttgatgctgaggtttgattctaaggtcttaggagaatggtacacccaataacaggtaaagaaaggacataaggaattggttttaaaagataaaaattattcatttgattttaggtgaggttatggtgtctacagtacgtccagatgattggagatggaattgaaggttgggggtgtaggtaaaaattagagcaatacactcgaccccaaatgagttttcctctctcttgccagaatgtgaagctttgcatagtgccacgtgggaggtgaggagtgaggaaggaaagtaccagacaacctggggctggaacacagcggccacctcttggaataagatcatcctcacatctgttttatgtttacagttaatagttaaagccacagaaatgttgccagataaaataatttagagaaaaataaagttacttgagtcaaaccgtggaaagcccaattattgtcacaaactggtaagggaaacaccatccaagtcaaggatgggggaaccagaacagaagggccaaccaggagtccagacaagcaggccctaagcagaagaacaaaagttggtccattcccaaacacaacagggcccagcccccaggctgtggatggcccaagatataaagtgagattcttagaggtggggcaggaaaccttagacgccgggtccaccctggggaaggcactggcaggaactagtaagcaggagatcttaatgggattcctagacggatcactttaagtcatgttaaaaagctaaaatagctactaggggttcacatgaaagaatattccagccagacgcaatggcttgtacctgtagtcccagctacttgaaaggctgaggtgggaggatcactagaggccaggagttcgagttgagcctgggcaacgtagagagaccccatctttttaaaaaattgaaggaaagagaatattccagttagacagctccctacgagcaaggtcacgtaggcaggctaaagtttcttgtcgaagcaagagttagcccaggccaggaaccacaggcagaggtcttcgaggctgctcagacctggctttttgctgctgagcctacaggtggcaggtggttttggtgagagctagggcaggtgggggcacatgcgatgtggggcagcaggatgtagcagcagctgaggcaggaagggaaagccaagagaggtaggagagagccagggtcatgcagccttatgtagcacagggctgtagggagagccacatgggcaggacttttgataagacataggcttatcaaagacgaaggctgttggtcttgggatttaggagatgaaaagagattttggagggaaattgttgagaagtaggatagagacaaagcagcctgaagagatgagtggatacaggcccagaatataagctggctgttaagcagtcatgaatgagaagcagctgagagaggactgaggagggttgcttgtgattcccgagacatgagcatttttccagggcatggaaaacatgcatgcagaaggttgaaactgacaaatgaagggaagaggggctagtgggagggacacatagctgtggaggatgtggaattcacagcacaagtggtggcatttccatctaagcagaggaacaaatggggacatttctgagcagtaatgtcatagaggagagtttaagaagctcagatcaggtggcctcagtcttctctgtatagcagttggtgataagcatcaactaaggaagatgacgaagattgagaaaagtggtaattgggactgtgtccataagggatccaggggatgaggattaaaaggccggaatgcaattgccagcaggcagataaccagccagcctcgtttacacctctctctaaccagtgattggcagcccaggagtggtcctggaaaccacccaagcctggagttgggcagcagagtgacctccatgccatctctgaaatgctcacaagggtacctaaggcctggggaacactgagagagagggaagcagacgcaagtagactgcacagcgctaaccagggcaggtcaggagagaaaaaggcagaaggatggggtgtgatcagatcaaagaagattaatgttgaaggttaggcttgttttaaaatgaaaacttttaagcacgtaagaatagagaccagtgaaacccacatactcgtccctcagattgaacaattcaagtttaagtttgtgtcagtgacatgaggaaggttaacagggagcgacagaaaagggggcgaggtgctggagtttccaacagacaggagccaatatatgaagatcctcctcaaatggccagtgacagggacaagggatgatgcatccactgaatgccaaatgatgacagtaatgcacagttttctggtactttgtacatagtgaggaaagggagagggacttgggtgaatgacaagaacaaggatggagagggtgacaggactacacacagggccaggcactggctcacacctgtaatcccagtgctttgggagaatggggtgggcggatcacttgagcccaggagtttgagaccagcctgggcaacaaaatgagacctgtctctattaaaaaaaaattcaaaaatgatccaggcatggtggcactcacccgtggtcctggctacttgggagctgaggtgggaggatcgcttgagcctgagaggttggggctgcagtaagctgtgatggcagcactgcactccaacttgggcaacagcacgaaaccctgcctctacaaagaaaaaaaaaaaaggactacacacagagctgatgaactttggaggtttagtaatgacggcaagggcggtaggctcggggtagcccacggcagagggcggtggggaaaatgatgaaatctaatgtgctgtctggttctttgagcagagacagaaggaatgctcatcctcggagaggattgtgagggacctggtttcacacaggggaagccagggttgtttgttttgttgaattttacctactttagggaagcaaagtgtggttaagggagagaacttggtatataagaggatgaaggggctgggcacagtggctcaaacctgtaatcccagcactttgggaggccaaggcaggcagatcacttgaggtcaggagttcgagaccagcctggccaacatggtgaaaccccatctctactaaaactacaaaaattagctgggcatagcggcgcatgcctgtagtcccggctacttgggaggctgaggcacaagaatcacttgaacccaggaggcagaggttgtagtgagccaagatcacaccactgtactccagcctgggcaacagagtgagactccatctcaaaaaaaaaaaaaaaaaaaaggacaagatttccctggaggtgctatggaaaggacaagcggggtctcatgggcttgtggggatttatattttgggtgataatgaggattatggaggttcaggggccataaggatgttcttacatgtgtgcatctgggcacttctgaagtcctgatggtaaaaaacaagaaacagaggccaagtgcagcggctcatgcctataatcctagcactttgggaggccgaggcaggcagatcacctgaggtcaggagtttgagaccagcctgaccaacatggtgaaaccccgtctctactaaaaatacaaaattagccagacatggtggcgcatacctgtaatcccagctagttgggaggctgaggcaggagaatcacttgcacctgggaggcagaggttgtggtgagccaaggttgcaccattgcactccaacctgggcaacaacagtgaaacgccatcaaaaaaaaaaaaaaaaaaaagagaatggattttcaggtcctggagatgaagacggcaggtcctttatgaagtagcttatacattaattaatacacaatgtatcctttgtgtgttaacttctctgggacaatcataattggctcgttaataaagggtaagaaatgaaatggtacttcagttaacctttagatacatcttgttattaacacatccattttggataatcctgtgttggacatagtatttcattgaggaatctaagaaaatgggagcttctttctgataggttctataatgctcctctccagaatatctgttaataatttgagttgtttcacaatggtttataggcattgtgacctaatttagtgttatcacgtattgttacagtctcaggctaatatatttaagtatttgtttatctttcttttaaaatatttctttgaatgaataaacaaaatatttcctttggtcatacataggctgttagcctgcacaagttctgaagctgaccattaggatggatggatgctctttttaagtcttgacctttttataacaacagcatcccagtaagtcattggcacatgcttccaaatgaaggtaatttctaaaggacatacagatttataggtgcactttaaaggacattggggcttggagagaggattcattttaaattgtaaaacaaactaacgtttgagaaccttctagggccaggcattttcattctcacagtaaagccatagaacaatagtatagcttttcccattttttaaatgggcatcaagaacattgagtgactttccaggtgtcacacagtgagtggcataatcagagtacaatttgagtcatgcccatacatcacattgccagtgattacccaaggaaagtgacgtacatgtgaggaggaggaacattagaaaggttaaaacaagctcttggactttacaggattttcccttactgcttcgagctctttaccattacaccatgaaccattcatctgactgtggatgaaaatgtctaaatgccacttaattttcatatagcaaagaaagctaaaatagatttctaaagattgccaaaataaatggaaatagaggttttaatttattaaatgtcaagtttctgttgagcattttcttccatttgctgcttcataagtcacataccaattagaaccaaattggtatgactttttgagttcgtagtcactgctcttaaattgctgactggcacatttgtggccattgagacacttcccatttttcctagctttcattggttttaaatattctgcttaggttttaaaagaattgtcattcaataagaatgatggcttggctttctgtcaccgtggtcatttgttcattgactgaggagcatctgttttcaatacagtatgcgttacacatcaacacatcattcattgctgtattacagaatttaaagtcaagcctggttaatactttttggtaaatatatggaccagagtggatttccaggaaggatgaatcatgttattaaatgaatgctcgttgaaaggtatgtgtgtgtgttaccatgtggagcattattctcggctgtcagcacacagttctctggcagtttgcttttcgagcatgtcatcttctaacaacagttgtattctcaaaaggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcaggtactgtatgagtcctcagatggactttacttgttttttaaggaccttgatagtaggtacaattagttaaatttcaatgactcataatgtttacttgaagtttcttcttaaactgtctgggctggttattaaatataagttggggcagttgcagtgaagttggtaatgtttgccatctgtgagttagggtttccccaaaggcaaaccctgggctaagaatttgagtgccagcagttttttttgcaagcgaatcccaggaagctggtagaggaataggagaaaagccaatgtaagtgcattgatgcatgtgttactgtgggtgactggaacacagtcccattgggaacctctgacagactgtggatcatgctttagaattgtccagctgagggatgaggaaactgaactacttatctaccacatcctgcccttcacggtagtagaaggtcactccctggggaattaactctctgatctggccacatgcacacttcatggcccaagcctgcccacagacacagaaaagccttggccatgtgtgagaactgtctgcaggtgatttgcatggtgagccaggggtatatgaatgaggtccaaccatgtttgctgtgtcatgcagtggtttgtataaatccacattgaatattggagcagcatccactttagggcagatgatgagatgaaggaacatgtgcaaagccagggaattaccacactgttttcttagcttattaaagctttgccttgatttacctgtttctgttagaaagaagcagcagaaacaaaggcccgggaggtagctgaacagatgcgtctcgagagagaacagattatgctgcagattgagcaggagagactggagagaaagaaggtaagggctgagggtcaggaagacctagggtaagtgaacaggaagtaaatccagttctcttctgcagtgattggatagaatgatcctaggattgtcagttaggtcaagttcattgataccactgttcaaatcttttatgtctttattagttttttgccatctcgttccatcagtgattgagaaagattgttaaaaactccatctgtagcgaggcatggtggctcacacctgtaatcccagcatttagggaggcagaggcgggaggatcacttgagcccagaagttccagaccagcttgagtaatacagtgaaaccctgtctctactaaaaatacaaaaaatagctgggtgtgatggcatgtgtctgtagtcccagctacgtaggaggttgaggtgggaagatgacctgaactcgggaagttaagcctgcagtgagccgagatcatgccactgcagtccagcctggggaacaggagtgagaccctgtcccaaataatagaaaaaagaataactccatctgtgattatggatttgtccatttttcctttcagttctgtcaggttttgttttatatatatttatcgtgatatgcctttgtctctagtgatatttcttgtcttaaagtctactttgacagccccctgccttttatttttttgagacagtctcactctattgcccatgctggagtgcagtggtgtgatctcggctcaccacaacctccacctcccaggttcaagcgattctcctgcctcagcctcccaactagctgggattacaggcgcacaccaccacacctggctaatttttgtatttttagtagagatgggatttcaccatgttggccaggctggtctcgaactcctggactcaagggatcctcctgcctcggccttccaaagtgctgggattatagacgtgagccactgtgcttggcctgacagcccttttatgattagtgtctgtatgtcaaatctttttcacccttctacttaaaacttcttctgtgtgtttttataagtaaagagcatatagccaggaattgttattttaattctgtttgacagtctttgtcttttaattggagtgtttagtccatttacactaactatacttatgggtaaaattgggtttaagcagactgattataaaggagtattctcatggtgtcctaggcccaacctgggctttgtattgctgtaggcctgggatccaggagaccagcctgtggccttctctcctgagatgcacctcagcctcagcctcactttctgtagggtggtgctctttaatggcaggtggtaatttgttgatttatacagagcctaaggagaagaaggagaaatatgggatataaatcgaatattgattctagatacgtactagttaacttctcaagcatttgaccttgtccatggggccggaggtgtacatctccaaaactagtggaaaacctttctatacttgttatcctcttctgacttttgccttttacaagttttctgagaaatgtgacattgcatgtaaaccaagctacttttatgtttttggtcttattgtcctcttacttgattttgttttttgttttttgtttttagagaatagatgaaatcatgaagagaacaaggaaaagtgatgtgtctccacaagtgaaggtaggaattcaaatgaccattttaatagtttatgtactaagtagaaaagaacagcagaatacactcagtgaaattgtaggtcttggcgacgattagccagaaaaaaatgcagttttcctgctttgttcctggctaggttaaggagggttaggtacctgaaaagaaagaggggcttcagaggtgggatgggtaagagatttccttagagtcatgggaggtgggatgaagagagaggcatagtagtccatgaataaaaaagagaatcctgacataaaaatacgtaagaataagggaaacacagctgaagatttaaagaattaccacagaacaggcagatggtccaggctcaaaatatcatcggatgcttttaaaaagtactttttttctgtgtgatgtcagccttccctcatttcattcaccttccatttgttttcagaaagaagaccccaaagtgggggtccagcctgctgtgtgtgtggaaaagaagacaaaactggttgtccccaacaaaatgggtgagtgtgacatctggttcttgggttcttccttttagtagcaaaagctcgtaagacttggtgtagggtaaacagacccatggatcccaagagggtgactgctggcaggggcctgtgcagtttcccttccctgggaatgtgtctccagcacagggactgtcagctccacttgggaacccactgggttccttggttactcccataatcccagcataggaggcactctggctgctggctcacagtgctttccagggagcttaactgctggtcaggttttattactgttaggacctgactctgctcttctccagaggttctgcacagacactgataatgtgatttgtcttctcttctcctgtgtgaaggtgattatatgggtttatttgtggctctttccacaaaagatgctgcagtatcagtgaagcagagcattaaattaattgccttgatctatatttctctgttactttatttagacattttatgattaacacaagggactttgtgttctcgatcagaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgaggtatattcatttcttttgcatttaagcctcatcacttctcgaaacactaccctttcttttagttggtttcttcgtcttttatacaaccaaatcacctaaagcaggtttgattgacattacaggaaagctctcagtggtataacattctagtgtcttgcgtcaggttccctagaagcagagcctggaacagagtttctagggcatgtgatttgttagaggaaagctcttgggagtttttcaggagaaaggggaaggagggaattcgctaagcaaggatgccttctcagctgaccccatgggagctctggaggatgaatttccaccagagacagttcctctgagcttctgcagttctggtttttctagattcttctctaagatctcacaaggaagaaaaagaagaacctggcagcagctttactctggctgttaagagattcctggtgacaggccctcagcccaccactcttcagagcctggatttgttcctttgctaggccttacagctggcgcaattatgaaactcctccttccatctctagggagaggaagagagagagagaaagaaaaccagccttggctgggctggagctggataagtcagagtggattggaagcctcactttagagaggaagcagagcgtgagattggctttgccagtgatgacgtgggctgtggtgggatcctttcattatgggccccccaaccttaactgagcacttcaggcgtttccacatgaactcttctcagcacgatcagattcacactcacaggagccctggcagagagaaacaattgttcccattttactggcgaagaaactgaggctgcaggaaggaaaagcaattcgcccaaggtggcactactagaaaggcagcactgggagccccactgttaattagggttcttcttcaacttgctttgaacttttggcattggctttctgtctgaatgtcccatttagaaagttctggaatgccttgcttctttgtggtagaatgctggtgcctgtgggtttttgtcctttcaccctttgggcaatgtgaccttggccatcacagccctgctcaatctgcttccctgttctcatacatggggcctcgtgtccaccatctgtcctcctcagatttgagcccacttgtattttttacagtgtgttacacaaaaactctgactctaaatccttcttctttagaagagtagtaaaacaaaatattgcaaatagaattaatatattgtgccatgttgtctgtctgtctctttctgcctctctccctctcgttcatctcttctagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtacagtcttttgattatattctaacttcataaccctttaactggggtttgtgaagataggatgtatatcactcagcctcttggatggtcaaattttatttgaaaaacgcaaacatgaatatattatggtatactacaacacacacaagaattgagacagatttcaattaattcatctgcgagccttcagcgccgagccgccttgtcctaaccctgctatttagggtgtgtagatgggaaagttgagaacactggctaaaggtttgactaccagtccagcctgagtagcttttttagggggcaaggaaagaatactctagtagtgttgcaaggtgatatgaataagatgaatttccccacctctagttttgctcagtgacatcccacattctatctagaatcattcatatacagggccacaggatttgctattctcttgacccattctggattcttccaaagcagacagctattcttggatcatacctgagggagagagaactgcagtttttgtgtcttgaaggttttttccccacctttggcctttttttatttttgccaaagtgcttccagaagctattctcatttgagcaagaatgtctatgagttatatacactctgtagtaaggtatacttagttacatatacctcacattttatttacttcagtttggggcttgtttttgaataaggaaaacataattagagtctgtcaccaaatcctttaataatttaataattccaattgctcctcccacttcagattctgtttttgttttcaagagaagtgatctcactctgttgtccaggctggtgtgcagtggcgcaatcacagctcactgagacttcaaactcctgggctcaggagatccccttgcctcagcctcctgagtagttggatcataggcacatgccaccaggcccagctaattttttttagtttttgtagaggttgggtcttgctatgttgcccggctggtcttgaacccctggcctcaagtgatcctctctccttggcctcccaagtacttactgggattacagccatgagctaccatgccttgcatccatttatccattttagattctttttttttttttttttttttttttgagatggaatctcactctgtcacccaggctggagtgcagtggcatgatctccactcacagccacttctacctcccaggttcaagccattctcctgcctcagcctcccgagtagctgggactacaggtgcacgccgccatgcctggctaattttttgtattttagtagagacagggtttcactgtgttgcccaagctggtctcgaactcctgagctcaggtaatctgcctgccttggcttcccaaagtgctaggattacaggcgtgagccaccgcgcccggccattttagattcttaaaagcatttttatattctcggcattttctcagtcactttattttttatacttcactcccataacaaattcactggccaaaataacagtccagtgtttttatttttcaaatgaggaaacaggtgggagaggctacagagctgaggtcactgtgttttttgtatacttgtttctacctgacctcagctcttgcctataagacaagtttgagagcccatttctcttggttcttggtgtgtggtgggtcacttttagagtaaactgtatcactggtttggaaaagcagctgccttcttggacacttaaaacactaaatcacctgagcattctatttccctgacagttacgtggcttaatatttattaagaggttttttgtgtttttaacatactttgactttaaaattagtttcccttcagttcacttacctcactatacagtaaggaacagagaatccacaaaatttattagagtattcataggtcctcaaatttatttcttacatctctaaaagaaatgcaaaacccctgtccaaaaagaaaaatctcaaattattttattcacactgcttgtatatttttaattatgattgggtctagttctcaaattcttctctaccaaaagtggtaccacccccaccaggagacgtttggacatacgttgatggtttttgttgccagagtggctgggggcatttgaaagacaaagcttgagacattaaatatctgcaggttttagaaaagttccatacaaggaaaatttgacccatctaaaagaatagtcctatgtaaaatactctatcacttctgttgagaaatactgtataagcccaggaggaaaatataattgccaagaaggtagaaagtgccacagtgtgttgtgatcgttttagtgagagaatagtgctacaaactgcacaatacttggttttccctttgatctcatctggttttgtttctgaattgacacaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgatatgtaccttgtgtttaatgtgaaatacattttcattgaa

SEQ ID NO: 3284 - DNA, 110281 bp, human; identical to SEQ ID NO: 3281

SEQ ID NO: 3285 - DNA, 110185 bp, human
gtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggtattatccccagagtgtggcgggcgcccgagggcttcgggttcctgtgggggggcgggcccggcggcccagggcaaaggtcctcgagcgtggggggaaggggcacggcgcagagctgagataaacgccctttccctggcccaggatcgtccggacgtgcatccaagggccgcacccctctctgtgcgagtggcggggttctttcttggggcgacctgggtgagtgggtacacatggggggtggcttagggtgggcggcaggtgtgtttgggatggaggtgcctgagggggtgctgcgggtccagtccccgtcctcgaggagcagccggcatgggggtcgttaggataaaccgagcggggttctggggttgccccggcctccgcgcgcgctctctctgcgttctgggaaacgcgcgcgagcgccgctgcagcccgcggcgaaggtggcccagcttcgcgcctcttggcgtttccagggggcaaaatcggcgtgtcacccattggcagaggcagattcgcccgggcggccaggcgtctgccccggaccgggtgctcctcccgcccggatgcgctccctgtcttgggaacgctgctcaggtggccgggccgcggccctcaatcgaggcagcggggcaaacaaggctctcagccctcgaggctgccgatgctgggagccatggagggctggtccctggctgcccagaagccagcgaggcagcggaggagactgtgaggacatttggcaggattttagataagcaggtctgatgctaacgttctgtaaagtggttgcaggtagtgcgggggtgtaagcagcatggaaaccgatttcatgctgtttttcctgacaacaacttttttatttttagttaataaggcaggctatttttaaaacattttttattgcagtctaatatgcatttaaaaaaccacacaaaactataattcgatgaattatcacatagtgaagatgggagtattttatatacgatgggccaagaaaaggaaagaaatcaagagaaatcttcttaaaacacgctttttcactggggttgagggggcgaggtagtattttctgactgggccttcagttgcatcattcttaggaggaggagatagcttaaatcatttccagtttgtatttttcattatgctattttaaaggcagaattcattaactgtcacaggataacgttataactacctttgaaatgtgtgcttttgtttttatcctttttgcttgaaacactcaagctgcatctgctagggaagaacctggaaactacccaccagaacgaccctccgtggcagaggcgaccttgtataataaaacactgaaaaggagaggttgtttcagtttgcatttttatttggttgagagcttaaataatagtttgtttcgatgttctgttgtactcatgagaggtggggaggggcggtatgattgggttttcagtgtatcttggattttatttgaaggaacttaaggggtttttttttttttttttttaatggaaacaaaattggggaaggggaggaggtacttttgcgggggagattcttaataagttctgtttggaaactattgtagaatcatttaatgcactcttctgatattaagattagcttaaggatatcttccttcatttgaaattggaaatatagaaaaatatgtgtgaaggtttaaaatgtgaaataagcacctatgtgcattaaggttggtatggtaaaattggaatgtttaatttaggtgccaggtgataccaccatttgttgtttgggggagttagcaaggccaggtacttaagtaaagtctccttagaaaaattatgattttgaggttttataattatctgtcctggatactgatcattcttggttacccaggcccttagcatttgggacccattcctaatgagacttaacctgcttttctagagagtcaaccattgttcctaagcttgggctgggtgctgtcaaggctgcaaaatacagaaagacctgagatgtttaggctgtccaacaattttgtgttgcacacttaggggatatgagttggcaagtggttttcctgggagctgtgtaaaagacggaaaggaaataccgctggtggtttcctctagcaacaggttcttccgatattgaaatcctgtgcatgttcccattaccccctagtgatgccttctttctttccttttaattacctctgaatagaaattaccagatctactgtccattttagtgcttgtctgatacacatagtataacaaatgagcaagtgcttgtttcaatctgcttaacaacctttaaccagcagatagaatcaccagatctcaaccatatttcctttctttctttttagatgaagtctcactctgttgtccatgctggagtgcagtggcacaatcttagctcactgcaacttctgcgccaccatgcccaggatcccagcactttgggaggccgaggcaggtggatcacttgaggtcaggagtttgagaccagtctggctaacatggtgaaaccctatctctactaaaaatacgaacattagccgggcctggtggcgcatgcttgtaatcgtagctacttgggaggctgaggcataggatcgcttgaacccaggaagcggaggttgcagtgagctgacctcgcgccactgtactccagcctgggtgacagagcgagactccgtctcgaaagaaaaacaaaatagggtggggcctggagatagagagtaggtggttattggagactgcgaagggtactggggggtgggaaggaggtaggaatggttaatgggtataaaaaaatagaatgaattaataaggcctggtatttgatagcacaacagggtaattatagtcaataataatttaattgttcatttaaaaataactactagtatgactggattgtttgtaacacaaaggataaatgcttgagggggatggctaacctgttttgcatgatatgattatttcatattgcatgcctgtaccaaaacatctcatgtaccccagaaatatatgcacctactacctactatgtagccacaaaaattaaaaattgtaaaataaaaaaaaaagtagagtgggcccgagtagcaaaggcattgggtccccaagaaatcggagttcttcatcctttttcaaagttgtgtttaaaaccattcttgaacgctttaatcctaaaactgttcagatcgctgggcgtggtggctcacgcctgtaatcccagcactttgggaggccgaggcgggcggatcacgaggtcaggagttcaagaccaggccggccaagatggtgaaaccctgtctctactaaaaatacaaaaattagccaggtatggtggcaggcacctgtaatcccagctactcgggaggctgaggcagggaattgcttgaacccgggaggcggaggttgcagtgagcagagattgagccactgcactccaccccgggcgacagagtgagactccgatcttaaaaaaaaaagtgttcagatcaagaagaacaagagaacaagttgagtttgtgcctctagagtctctttggtagtaggaaggaccacaaacttcctacaaagttgtatttggtttgtggctcctggctttttttactgatggcagcataggacttagacttagcaggaccttcaggacaaactgctgaaagtctttgtgatttctcttctcatatcctagccatggtgacatagctgctcaaagtctgtcatttctaacctgcttcctctccaacatgaaaggatgttttcctctcaggtgccccatcttctgcagtggctagtgttttaaaagaacactttgtcttcttgtaattacattgattgccttacaaaacagaaggattcacaaggttgatttgggcaggcgagagatggagatttctgggggctgttggtaaatatcctggtgggtcttgttgagaggatttgatgagatatattggctggtgatacaatgatactgcctggttttagggggctgttcatgtgctaagttggctcaggcggcagttccaagatttgaaaacttcccatggccctgccctccggtcccttttgaaaggaatttcaccagaagaaggaagagggggtagtagagggcagccgcccttagggagggagtgtccactgtccacctcacatctgagtcggccgcatttaaatatggagtttaccgtcttggcatctgaggctctgggtctgactaggccttgggatcccgcctcgtctgcctctgaggtcagtctgaatgcaagcccccatctgcttttctgttgggaagcatttgttttcctcttgcctaggaactttttctgtttttaaaagccttgtgactagcagagtttgggttgtcatttaagcgaaaggaaaacaggtatgagtgagccgcatgcatgcaaagcatttgaggcaacagcagtgatgccaaatgcctgagatccttggaatgacagggtctgtccccagggctcctagcttctgaccagtgctgggttcgttcaccacctaaaaagacttggcttttcctctcagtgccaaataggttggtgccttgtagcccccaggcaaccctttggaatgttccttgctcctttgtcatctcacccgcttcatccgtcccaccctctgtgtttctgtaataacagctttatggctggtcgtggtggttcacacctgtaatcctagcacttcaggaggctgaggcccacagatcgcttgcactcaggagttcaagaccagcctgggcaacatggcaaaaccctgtctccacaaaaaatacgaaaaattagctgggcgtgatggcacgtacctgtagtcccagctactttaggggctgaggcgggaagattgcttaagcccatgaggtcgaggctgcagtgaactgagattgtgccactgcactccagcctgggtgacaaagtgagagcctgactcaaaaataaaaataaacagctttatcatctgtataaaattcatatgccatatagtccacccatttaaaatgcacaattcgatggtttttagtatattcacagagttgtgcagccatcaccacaatcaattttagaacatgttcaccaccccacaaagaatccccatactcactgacattcttcattcccccggcctcacaactacccatctgtctatatagagaccacgagacttctgccgggacagtcttcagcctttggtgcagacacgcgttgcaattgcctagaagtctgtgggtgggtcttcatgcattagaggtttagaaaccaatattctgcatactctgtccttcaggtctaagacgcgcttttaccctgaagccttgccttttcacctcctgtacattcccactccacagggcctgcaaagcgctcagaacctgaatgtaatgtacacagcggtctgcagttatatactgcacatgttcattttagcttcccagacagtaatggccgctaattgttgagcacttatgtgccaaccctcatagttctgggggttgcctgggcttattggagaagttctgctgctccatttggggtcacctggagtccctcatgctggtacagtctgctggtctgctgggagctcagttgggctcgaaatgtccaagatggtctctcattgtccaggtacctaatcacagagagtctgtcctggactttctaacagcgtggctgctgtgctttgaataaggaagcagaagttgccagttctcttaaggcctgcacatagaagtcccagaatgtcatttttgctgtgttcagtggtcaaagcaagtcccaaggccagcctagattcaaggggagaggaaatagactccacctgttgatgtgagggcagcatgcacctactgggaaatgagaaattgttagtggcccttttggagaatatctactgtaataggcaagtacagtcgttccttggtatccatgggggatttgttccagcacctctcaagaacaccaaaaatcaaggatgcccaagtccctgatataaaatggtatagtatttgcgtgtaacctatgcacatcctcccttatactttttttttttttttttttttgagacagagtctcactttgtcacccaggctggagtacagtggcacgatctcagctcactgcagccttgacctcccaggttcaagcaatcctcccacctcaacccctccaaggagctgggactataggcatatacctctatgtctggctcatttttgtttttgttttggtttttttgagacagagtcttgctctgtcacccaggctggagtgcagtggtgcgatctctgctctctgcaacctcgcttcctgggttcaagtgattctcctgcctcatcctcccaagtagctgggactacaggcatgcactagcacgctcggctaattttttgtatttttagtagagatcgggtttcaccacgttggccaggctggtcttgaactcctgacctcaagtgatctgcccacctcagcctcccaaagtgctgggattacaggcgtgaaccaccgtgcccctccctcccttacactttaaatcatctctgggttactgataataaatgtaaatgctatgcaaatagttgctatactgtgtcgttgttttgggaataatgaccaaaaaaaaaaaaaaagtctgtgcaaccatccactttattttatctgaatatctgaatcttttctttttttttaagatggagtctcaccctcttgcccaggctggagtgcagtggtgcaatctcggctcactgcaaccactgcctcctgggttcaagtgattctcctgccttagcctcccaagtagctgagattacaggcctctgccaccacaaccggctaatttttgtatttttagtagagtcggggtttcaccatgttggccaggctggtctcgaactcctgacctcaggtgatccgcctcccaaagtgctgggattacaggcatgagccaccacgcccagccttaatctgaatatttttagtctgtggttggttgaatccttggatatgcaacccttgaatacagtgggctgattatatgttttaattaagaaaggttatgtattcagcgagaggtgagagattaaaaaaagaagaaaggttaagttatttgcccaagggcacacagtaagtggcaaaccaggcttcacacccaagtgtgtttgacttcggagctgagaaacttttttttttttttttttttttttgagacggagtcttgctctgttgcccaggctggagtgcagtggcatgatcttggctcactgcaacctccgcctcctgggttcaagcgattctcctgcctcagcctcccgagtagctgggactacaggcgtgcaccaccatgcccggctaatttttgtacttttagtaaagatggggttttaccatgttgtccgggctggtctcgaactcctgaccttatgatccacctgccttggcctcccaaagtgctgggattataggcgtgagccaccatgactgacccagagctgagaatttttaaccccccgtgccactgtgcctccacggatggataataaactcctttcgcgcatgagctgtgtctcccacatctgctatacccctctgaggatctagctcagtactatctagccacatcttacaaagatcttgtatgccttttacttagtacacagttgtttttctccccaaaggcgatggggatctcatttcttagaattacagcaaaaatgttattaaaatgcttagaggaagataagttccatttaatggaatttcctagtttaccaggaatgaaccccccatcctctctgtgcccacaattattgttaaggatctgaagatacccttaatcggcttcctgccttaggacactgtgttgggtatgattgaggttcttgctgttaactgtggtcattgctctagaaggaccctggaagattctctgatactctaggctagtgtgtctcaaactaactctggtaaaggagcagtttttagtttttttgtttttttttttttgtaaatttccaatctgctgttgaccagtatcttggtaaaacacagtaaagaaaaatatatgaaagacatggaaaatacaagtcccaatttttaaatatcaggttagattaatattagatttaaagagctcattaagtaacagaatactctgtccagttgctgtaaatgttctaaatgcatgccctcggtggggtgcagtggctcacacctgtaatcccagcactttgggaggctaaggcaggcagatgacttgaggtcaggagttcaagaccagcctgggcaatatggcgaaaccccgcctctactaaaaatacaaaaattagccagatgtggtggcgcatacctgtagtcccagttactcgggaagcggcggcacgagaatcgcttgaaccagggaggtggaggttgcagtgagctgaaatggcgccactgcactccagcctaggtgacagagtgagactctgtctcaaaaaaaaaaaaataaaataaaaaagaagcatgctctcaatttatgcctttattctttattgcagattgataatgaataataaagagattgtgctccctccccacagcccatcagggttaggctgctcagggtttcctgaagaaaaaaacaaacaaacaaaaaaaacgtaaaaaagagagactggcacctgtccacaggacacactttgaatagctctgccctgggccagtatttcccaaagggtatggtacataagagggttttagattgcatgtggacagacttatctttttaactttagattaatagttctgttgattcttcaatttattttaaaactacaactagtacatcatgctacagtttctgaatattttcagaatgagtaaaaagtgaaaaaactacaaaaactaagcgaaaataagtcaatttaaagaaaaagactatccactgggcctggcgtctaggaaaaaaattttaaaaataaaaagaccaaataatagaagtcagtgctggctaatacaaacagaatgctagccacatatgtaatcttaatttttctagtagacacattaagaaaaagaaacggtgaaattaatataatacaacttacttagtcaagtatgttccaaaatattatctttcagcatgtaattaattaattaattttggggggggcgggaaacagagtctctctctatcccccaggctggagtgcggtggcgtgatcttggctcactgcaacctctacctccccggttcaaacggttcttatgccttagcctcccaagtagctgggattataggcacatgccaccacgcctagctaatttttgtatttttagtagagacagggtttcaccatgttgtctaggctggtcttgaactcctgacctcaagtgatctgcctgccttggcctcccaaagtgctgggattacaggtttgagccaccgcgcccagccccttcatcctcttatgtaccaagttctctcccttaaccacactttccttccctaaagtaggtaaaatttggcaaaacaaccaaccaatcctggcttcccctgtgtgaaaccaggtccctcacaatcctctccaaggatgagcattccttctgtctctgctgaaagaaccagacagcacattagatttcatcattttccccaccgccctctgctgtgggctaccccgagcctaccgcccttgccgtcattactaaacctccaaagttcatcagctctgtgtgtagtcctttttttttttttctttgtagaggcagggtttcgcgctgttgcccaggttggagtgcagtgctgccatcacagctcactgcagccccaacctctcaggctcaagcgatcctcccacctcagctcccaagtagccaggaccacaggtgagtgccaccatgcctggatcatttttgaattttttttttaaatagagacaggtctcatgctgggattacaggcatgagccacctcacctagcctcagcatgtaattaatattaaacgttattaatgagatatctgacattcttttctttgcagcaagtctttgaaattccatgtctattttacacttctagtgtgtctccatttggactgtttgcgtttcacgtgctcaatagccaactgcggctagtggctactgtattgtacggcactgacctagagcatttccatcacgcagggagttttgtggtctacattgagtctcatggtgactaagtattcagtgtgatgactgtgctgtcaagtatggcgtgaagcacagtatgtgtgctgtggtagtgagtccagcttggatctcttcttcatgaatgtagaggaaatggaaacacactttgatggaatgggctcccccatatcaggcaaagcaggcccggattccccaggcttttgaagggatatcctgattttgctttccccagcctgggtgaagggagtgcaccaaggctgtgactagtgggtcctcacacagattattgtcttggggacctgatagactgtggaaaggggatggacttggctttgtgggaattattaagctgtcatcgaggaaaagtgctaaggtttgaatgtccattccaaaactcatgtcaaaattgccattgtgatggcattaagagatgggacctttaagaagtgagtaggccatggggctctgccctcatgagtggattattgttgatagtggattcggtttggcccccatttgctctctctgtatcatgggcttgcttgcccttttgccatgttttgatgcaagaagaaggccctcaccagatgccaagcagatgctgacaccaccagcatccagaattgtgagccaagtaaatttgtttgttataagttacccagtctgtggtattctgttatagccactgaaaacagactaagacagaaagcatggtattgaaaaaacatggaaccataactgtgggaggagagagctgtattagccagcttaggatctcctgggtttggtgttggggtcggggtcaggaatccctgctgctgggtagggtctgctgagtcgggattcaatgggctctgtgagattcgatctggtcatcttccccagctggtgtcatgtcttcctagtgccttgtccacagaagccacttgctgattctgaccaataggtactgattgactgttaggacagatgccctaactctgggaactacaccattaaacagggaagttccagtgtatctgggctggttctgcctccatctttctaggtttgatgtgaaagagctgccattagttacagatggccttagtggactgattacccagcacctgcttcagggcctgcaggatgaaccccttcccagaccagcttgtctccttcctgagcagttggtctgtcttcaccgttggtcactgattccttcagagttgactcttggtttagcaactcaaccagtgtggtactctggttgctgtggtagatgtatgggattaacgtccttttcagctccattttttatccctacccttgtttttctctttctctcctactttctgtatttatttctactgtattttatataagcaatcttaatcttttctggaaggagggagggagggcaggaaatgacctcgcagctggagtctcaccaggcacctgcagccctttattaagcagtgctctatgtccctgtttcagaacaacaccttaatatgtgctattaacttgaagtaaccgtctgaatcgtaaactgggcaaaaccgaattctgctgatgtgcttattcttaaaaacagccccccatgggattcctgtatgttctcttccttcaatacctagcgcgttttcagcactacatttaccagagggaaagtgtattgttcatggggatagcatcacctcttagcaggtgttgctcttttctaccctattaattgtatttgtttagttttcttgatcaccagtcaggggtgacagtgggtggtgaaatactgtgacagccttcagtggaagctttccttgtacctgggtaatttttcccctggtggagatacgtgttatgaataaaatttagcattgatcattttcattagctagataatcaatatttttaagcagttgtagttatgtctacagaccaaaagctcttttaaaaaaatcactaattctaggccaggcgtggtggctcatgcctgtaatcccagcactttgggaggccgagaggggtggatcacctgaggtcaggagttcgagaccagcctggccaacatggcgaaaccccctctctactaaaaatacaaaaattagccgggtgtggtggcgcacgcctgtaaccccatctactcgggaggctgaggcaggagaattgcttgaacctgggaggcagaggttgcagtgagctgagattgtgccactgtactccagcctgggctacatagcgagactctgtctcaaaaacatcataaactaaacattaaaaattatgcattttaattgccattttcttactgcaaaacatgttcctgctctccctttttcctctcctcacccacctaaatttccacttcacttgattttacttttgccagtcacaaatttttttctgaagaataattgcttcttattaatagtccattgagctccacatatccctaatcttctgggatgagattaaccctttttatagaagaacaattaagtgaggaaaatggactgtttcactataccctgttcaactttaatttctcttagttgtgttttagtttctctgtttcaaccaagaggcccaagggttctcagtgcctttctactggggagtgttgaatgtcctttgtggtacatagttttatctttactgcttaaaaatcaaaaggattatttacactttggcatgtaaagattatatcagagcaaatggctcttaattcaagcagagataagacatgcaaggtacaacactgtccagtagaactttctgtgatgttggaaatgttctaggtctgaactgttccatatgatggccactagccacatgtggctgttgagcattgaagacctgagtttttaattgtttctaaatttaaaaaaattgaatttatatcagcacatatagtagtagcttctgtattggactgtacaattaactagctgttgactaacctcgacagattaggatcaggaatgaggaaggagtttcagatctcaaacaaagttacttcaaacccacctactcttggtttctcctgtacaggctttgatatttggcacttgtcattcaaccactctcagatgctggtaggccaccaagaacagaaccagcagttagctccttgacactgtatcaggtctgtaggacagtgatcgaactggtagacaagacttgttcctggctccgtggtggccctggagtgcccacagtcagccaatcctctctgtcctgtctcagcttttcaacttggcacaactgaagagtaaaaactggagccagggtctttagtttcacaacttggttggagaaaccagattgacttacaagccattaccaaaccattagataaaaccagtagctagctatgcaggatttgggtgagctgtgggcagagcttttccagcaaaaggttggcagggacctcaaccacaccctaggccagagaaccccgtggcaggaagtgaggttggtgggggcattggatgcctttgctgagttaatcgtgttccctgttctctagcaagtactcagtaaaatggataagtctcagctctttcattctagcttgctccttacaaactgcggcctcagacattggcccctagaactcagttgcttgtctgtacaatgagattgtacacaaggtgatcttactggtgcgttccaactctgtgatgctgtgatcctccacagctggcctaggaagcagagggaagcatatggctgctatctacccttctcattagtgggatcaccagccacatagcttagaacgactcccccccaccccgcccattacagccaaacccgagggttctgccttctttatctctcatgaccgcatccccatggccagtgctttgggtcagactctgtcatctagagcctcaccagtatcagaagaaccttagggatctctgtccgtccgtccaggtcaccgtccctgtcatggatccttcatgtcattctcttgctttaatctcctctgacacttgcctagcacttcttaaagagtatattctaaactgctgttggagttttcaggcatgttggaatggggctccaatttacccctccacccccatctctctggcctgtaaccactcccgctcagaatgttcagcacactttgcacgtgactgcttgtgtacatgctgttctcttcacctggaattcttttcctctctgtgtctgccatcttcattcctgtctaccctgttcatctttcagtacttggctcacacctcacctcctctctgaagccttccccaaccacacacacttttgatggttttttcccttcttattcattttccattacagcattgattatgaaaatgcagataaaccatgtgcaaataaaactgggactggcacttggaaactaaagtacacaaatcttaagtgcacagtctgattatgtatacaaccatgtaacccacacccagatcaagatgttaaatactttcagtacccagaaggctccttcatgcctcctcctagtcaatacttctctcaaaggtaaccactgttctcacctcttttcactatagatttgctttgcttatttttaaattgtattaaaatagattcatttaggagatacttttttattgtgataaaatatatgtaacataaaatttactgttttagcaattttgaagtgtacagttcagtggcattaagtacattcatgttgttgtgcagccaccaccacaatccatctccagaactttttcatcaagtatatccttctttgtgtctctttttgttttcttttcacttgacattatgtctgcaagattcacctatgttgtcacaggtaccagtggttcatttctttttatttctgagtagtagtactttgtgtgactgtatcacaatttgttttatcaattctcttgctggatggacattgtttttttccagctttttattcttttgactaaaacttttatgagcgttatgcttgtgcagataccttgatgcccatacatttctgttgggtacatacctagaagtggaatgggatctgaaatgtcacttcatagattctatataaagagtgtttgtaacctcctgaatcaaaacacaagttccattctgcgagataaaatgatacatcacaaagcattttcacagttagcttgtttctagtttttatcgcttgatattcgattttttcttataggcctcaatgggctcagaaatgtcacctcgtagattctacaaaaagagtgtttccaacatggtaaatcaaaacacaggttccattctgtgataggataggcatgtcttcagcattagcggatattgccaaaccattttccaaagtggcttgtattcatttcttattgctgctataacagattatcacaaactttagtggcttaaagcaaaataaatgtattatctcaattccagacgtcagaagtcttaaaatcaaggtgtcagcagagcctttcaggatgtgctaagggagaatctgtttccttgtcctttccaacttctttttttgtttgtttgtttttttttttttttgagacggagttttactcttgttgcccaggctggagtgcagtggtgcgatctcggctcaccgcaacctccgcctcccgggatcaagcgattctcctgcctcagcctcctgagtggttggaattacaggcattcaccaccacacccagctaattttatatttttagtagagacagggtttctccatgttggtcaggctggtctcgaactcccgacctcaggtgatctgcctgtctcagcctcccaaagtgctgggattacagacttgagccaccacgcccggttgtcttttccagcttctagaggctgcctgcattccttggctcatggccccttcctccgtcttcaaggccagcatcatagcatcttccaatctctttctctcttgctccttcccctccctcccccccagctctacttccactgttacatctcttctctctaactcacctacctctgttgtgattaccttgggcctacttggaaaatcctggataatctccccatctcaagagccttaacttgatcacatctagaaaggtctttttgttatatgggatagcatattcacaggttctgggagctagaacatcgacagcttggggccaatattttgccagccacatggctgtaccattttgtattcccaccacagtgcatgagagttctagttcctctccatctttgtcagtacttggtatggtcagtcttttgaattgtagctatactggtggagatgtaggggcaagtccaaggctgccaccccaggcagtgcatcctcctttgctccagtgatagctttattgcaacttataagcattatattatgaatatgtatttacattcctctgtcttagccaaactaagcaccacttcatgagcaggctatatagtagttgatttaataaaaggtccttggatgcgaagaactgactgagggcagttttcagcagagcagggaagcagagctgaagatataaatgaaagcccatgcttccagtctcaactctgctcagcccccaggatctgagggaagtaggatttccctcaaataaaaataggagtagagcaaagaacctggcttccaccttctgcacactgttgtctttcccaagatagttaatctataagtgagtaatgccctagaaggaaatttgggccttgactcctatgggtgttggttggaaatgacttcactgtatatgtaaatgagaggaaaatacagttccagctggctactggggagtctgatcttggaccctttgcagggactcaggttttccttttccttggactctgctcatgtagcaacatactgcagcttcttacttacagaaggaaagactccaaggtaagtaatgctttcttgatctcagggaatgtctgtcatgtgtgtagacttaaacccaccttggaaacttgaggttggaatgtctgcagaaagtgaagccagagtagagatgaatttccaatgcccctggacacaggatggtgggcacagatgtcttcgtactagaaaagaatctcggaaggtgggattagtattagataaaaggcagacaggatgatggcttctttcgggagcatcctgatgcaaataagcactttctgggttctgtttcattccctagtttactttgctgggcacacacctggtttcatgagggctgtaaggtttctaggcttcattcttacctttctaggctgccgaggtgttagcagcattcctgcagcttggcattgctgtgacctgagagagagagagagagagagagagagagagagagagtataaacttgcagtgtggcagaggacttccttggccctcacaaggtcaaccaaaacctggctggttggtatttggatcaaaagggagtcggtctttgaagaaaagcattatctcaggataggaggtactgtgacaggcctgtgccagagttattggtccctgtttaaaaatgtactgacagtgtcacagctttagtaatttaataagtacatgtgtggttcacaggctgatctgaaacaagctggctgtgccagagtgggtcacacctggaccttgagtagtgtggatggcacacacaccatgagggttgggacagcctgaaccaaactgtggccgtgtgtttatggagtgctgctgacttcttagacatccacttatctctgcctgctgtgtttgagatgtggaaaatgtcaggtggcagcattcatgctgagaactgtccccctgggatttggactccctctttactcgctgccatccaggtctggaggtgatctcgagaaagaatatggggtgagctgtcctctgtaatcagatgggtgttcactttttccaggacaggcactggatctccgctcaacattctctggggctggaggggtacccttcacctcctgggtcaggaagctctttatgttgatagaaacatgtctcctcttgctacccgctcccccccccaccgtgtagagagcggacaaccccttggcatccttttcacagaacttctaagtctccataaatgtggggaccaagagcctttctgtggcctacaccacttccagttgtttaaaccctcctggtgtaactttttatttggagtttactcctgtgacattggtgtctctcttctctaactgtttgcacaaattgtccatagtgagccctttcatctcagttaagaatttcccacttaatctgatcacctactggcttggccactaactagctataggacctggccacaggttagtttcttggcctcttctttacctgtgaaatgggaacatatctgaaatacttcatggggttgacaggaggattgtgaagtgttgcatggaaagtgtttgtagtgcagtgtcttgcacagaggtagtactctgttaagtaggaggggagcttatcatccgtgtagccagtacgaggacctaggctggatgtctgtggacataaaaaagattttttgttatagtgtacacttatatcaatatagtcatattgatatatttatgtatggtctttgccttccagggaactagtaacctagtgagataggttgtctctaacttactgtaatccaagttgagcattgataagtaccataaatgaaaatagaaaaatggaccataaggctatagatgaacagttcattctggctgagagctggggtcagtttttgtgcatttatgagtcccaaaggcaagtgatttttttgggagggacagtcacttatactttggtggcccatggttagcaggacagcacttcccacctggaagtggcctctatctttggccacgttcttcagtttctgcatagaaatgacatttctttttctcccacctagtgcttaatttatgattgaaattcttgaagtatccagtgatgccctattcaggaggctgtccagccagtagcattcctttttattcgttgcctaatgcaacactgacagtagcgttcatttttctcttcctataagtatgtcaaagtctcttatcctaggtcctagttctcactgtcctaggtgagctttctcttcccactttgtgcagttagtatttttccacagacatagaagaagaaaagagcactcttgttttttggccccacccctctttggcacacactacttaggtgcttcaccccacacattggcccagagcttaagagaaggtcatctgactgtctggagctgtggaaactgcacatggcttttggcaagagaatcttgtggtgtgctataagtttttaagtttaagagtttacactctgcactggataatatggtaactaattccatgtgtggctacttaattaaaattaaataaaagtaacaattcagtttcttgattgcactaagccacatttcaagtgctccatagcccagttggatggcacagatatagaacacttctgtcattgcaaaaaattccatgggacagtgccggtctagggggttgccttatagttgtaggctactaataggaaagatagatgttcattcaggcttcagtggtttagattttcctcctgaatgacccaagttgaatgtctaagctttaaatctcatcaactaatgcaattaaaatattttaaccttcttaaatttgaatacaaaaagggtattcattttctgaagtcttttttgtgctgccgaattaccctgaagtagatagcaagtgtggattcttacaggtgaggaccttaatttgttttttattgtggtagaatatacataacataaaattcaccactttaaccattttaagtgtacaatttagtggcattaaatacattcacaatgttgtgtaaccattatcactatctgttttcagaactttctccatcatcccaaatacaacatatacccactaaataataacttccctttccacctccccccagtctactttctgtctccctgcatttgcctattctaggtacctcatataagtggaatcataaaaaatttatccaatgtactgactcatttcacttagcataatatcctcaaggttcattcgtgttgtatgtataagtagtatgtgtcagaatttcttttttttctttttttttttttttttttgagacaaggtcttgctctgtctcggagactggagtgcagtgatgtgatcatagttcactgcaacctcgaactcctgagctcaagtgatcctcccacctcagcctccccagtagctaggactattggcgtgcaccactgtgcctggctaattaaaaaaaaaaaaaaaaaaaggacagggtctccctatgttgcccaggctgatcttaactcctgaccttaagcaatcctcttgtcttagcctcccaaattgttgggattacaggtatgagccactgcacccagccagaatttcttttcttttcttttctttttttcttttttcctttttttttttttttttttttttttgaggaagagtcttgctctgttgcccaggctggagtgcagtggcacaatcttggcttacagcaacctccgtctcccggtatcaagtgattctcctgcctcggcctcccaagtagctgggattacaggtgcccaccaccatgcctggctaatttttttgtatttttagtagagatggggctttgccatgttggtcaggctggtcttggactcctgacctcaggtgatccacctgcctcagcctcccaaagtgctgagattacaggcgtgagcctctgcacccagacttcttttctttttaaggccaaataatatttctttgcatagatataccacattttgtttatccattcttttgttagtagacattggggttgcttcccccttttggctattgtgaataatgctgctgtgaacataggtgtgcatacatctatttgagtccctgcttcaattcttttggatatatacccaaaagtggaattactggatcatatagaaatgctatgtttgaccctgttttgtgccaggggagaagtggggagacagggtgggtcttgctctgttccccaggctgaagtgaactggtgcagtcgtagctcactgtagcctcacattcctgggcttaagttatcctcccacctcagcctccaaagtagctggaaaaacagtcacttgtcaccatactcagctaatttttaaattttttgtagagatgtggtctcactatgttgccaaggttggtctcgaattcctggcctcaaatgatcttcctgcctccacctcccaaagtgccgtgattacagacatgagccactgtgtgtggccttggccctgattgaaaaacaaacaaacaaacaaacaaacaaacaaaaccttaaaatcattgttgagatataactcacaataacataaatttcattcttgtaaagtgtacatacagcccagtcgttttaaatatattcacgaggtcatgcgatcatctccactagtcactgattttttttttttttagacagagtctcactctgttgcccaggctggaatgcagtggtatgatcttggctcactgcactgcctgggaaaacaggcgtgagctactgtgcccggcctagtcactgatttttatagcctcttaggactaaagggagagggagaatctagaaagtggcttgggtgcaaggaagggagctttcaggattatgtataatactcttaaaacaggatatttgttaatcctagcactttgcgaggccgaggcaagcagatcagttgaggtcaggagtttgagaccagcctggccaacatggtgaaatcccatctctactaaagatagaaaaattagctgggtgtggtggcacatgcctgtaatctcagctacttgggaggttgaggcaggagaattgcttgaacccaggaggcagaggttgcagtgagccaagatcgtgccactgcactccatcctgggcgacagagcaagactgtcaaaaaatatatatatatatacatatatatgtatatatatatatatatatatatatacatatatatatatatatatatatatacatatatatatatatatatatatatatatgtatgtattttttttattaccaattccttgaaacgtctcataatctttagcaacaatcctctgcccactgcgaggctttctgacctgaagtttagaaaggctcccctgctacctgacatattttcagctactcgtgaggccttgttttatggaacgggatgttgaagaacctcacaaatgggtcagactccccagcaatgctctggaagcctgcttctataggagcagacaggtgttcatgtgctataagctttgtcacatgcccttccctagcagggaactacttctgttccttctctggttctggtcctaaattctgaagctacttgcatttccaaacataaagcaagttgtttataataaatgccttaaatatttgattttcagattcatattgctctgctttggaacaaggaatacaactcctctgcttttgttattacaagccatttatacatataccagggtgctctggttttcacttgttctcatcctttagttgtggttttaatattttgtgctttggacatggttttattgtggttttcagatacatggccagttttcttttctttctttttttaatacgtcatacaattcacccctttaaagcgttcagttcagtggatttagcatattaagtcatgcaaccatcaccacaatcaattccagaatattttcatcaccacaaaaagaaatcccttacttgttttaccccaaccccctgccctaggccacccaactactaatctcagtctctatagatttttgaccagcgttcttgcattcttgtttaatggttattttttatttttatttttatttttttttgagatggagtctcactctgtcacccaggctggagtgcagtggcgcgatcatggctcgctacaacctctgcctcccgggttcaagcgattctcctgcctcagcctcctgagtagctccgactacaggtgcgtgccaccacgccaaactaatttttgtatttttagtagagacggggtttcaccatgttgaccaggcttgtcttggactcctgacctcaggtagtccttctgcctcagcctcccaaagtgctgggattacaggcgtgagccaccgcgcccaggctaatggtgactttcttcctctctaaattataatataagccaccacccttttttccgtctctgttccatttttgtcttttccccttccctccctcccctcttctgatattagcaggttagctctaaattctccttaattagctcccaaaccggatgaattggtggatgtggcacaactgcaggaattcatccaacaaaccagggatggacaaatagtgtgtttgagccctcgaacacccttccaagtcatctgccttcattctgtcactatgaggccagccttcttttcactggctgggaggctgtgggaactgcgagctaggccagcaagagagaactgggtggaagctggtctcagattgatcagtcacacagcctggggagcaatgaactgagatttcagtgtgtggcccatgtgagtgagtactgggacagaaatcaaatgcttgccttacaaatgtagtgtccagatgtataaattcagccactggatcctcctatcaacagaaacatttaatagtcaaattacagtttcaaaatcagtttacaaattacagtctgaaaatatcagtatttaacttgagaagcactgttactcgtacctggtacagagtcagaactcagtgaaacttcccctttgccctctgaagttttgctgaaaagtgaactcacaaaagacagattaattagagaaaaggcatacacattttattcacgtttatacagggagaaccatgagtgactacctacctccaacagggttcagaggctttatataccatcctggcaaaataagttataagacgggggaagaagaggaattctgttgagaggatcactagggagaataagtggacaagataacttgtatactatcttgtgaacgggtctttcaggtgtggttacattcctggtcttacaaggaggggaagaaaaaaataaatgttccttttggtgggtctggactttaggcacataaaggaacttcaacttcgtcctgctttgggagagacattggtagggggaggagggggaaggtcagagagaccttgaggcttcttcagttcagtacgtcaaagtgccatattttgggatatctgcttctgagccccaacactgttattaagaggccatattttattgtaagcctactgtatacaaggcacaggttaggttttgtgaaaaataagccaaagcttcttgaatggaattcaagccctatttatgttataatgtgcaggagtttagcaggttaacactggggaagcagagacttggtagcatccacattttgcttgtttctttagaaccatatattttattaaataaatttttataaaacaatgtgttaactgtagataccctcaacacaggaaaggtttggttaagcttagattcttgctgggaattgtagatattataatttcttgtggataatttaaaaaatttatcatttactattggccactggtagctttattcaaggcaaaccatcttgctcaaaacaaataaccttgaccaaaaaggtagccaggatcctatttagtctatctacagattgtttttggttaaaaagacatcagtgtttgttccatgccatatatgtatctcctgtttcattacatctccgtattgctgggaatgaaacgagtaccagcaggcccttgctgtggaattttctgagcgaggtcagagagaagcacagtgtacttttagaacaagatctgtcctgcctttttttgtattctggagtacacttggggagaaatagagtaagctgctgtttggggaagaagtttgggcttttgatttattttgaaggagtttaagaaatgctaccaccatgcctggctaatttttgtatttttagttgagaagagatttcaccatgttggccaggctggtcttgaacttatgacctcaggtgatccacccatctcggcctcccaaagtgctgggattacaggcgtgagccaccacacccagccaatactagttttttttattgctaaagagtgttctgggccgggcacggtggctcactcctacaatcccagcactttgggaggcagagacaggtggatcacctgaagtcaggagtttgagaccagcctggccaacatggtgaaaccccatctctagtaaaaatacaaaaattagctgggcatggtggtggccgcctgtaatcccagctactctggaggctgaggcaggagaatcgcttgaacctgggaggtggaggttgtagtgagctgagatcgcgccactgcactccagcctgggcaacaagagcaagactccatttccaaaaaaaaaaaaaaaagagtgttccactcacagtgaatataccacagtgtttttgctccattgctgttttatccattctttctttcttttttttttgtctaagatgaggtctcactctgtcacccagactggagtgccgtggctctacctgggctcattgtaatcttcgcctcccaggctcaagcagtcccacctcagccttctgagtagctgggaccatagtcacgtgccaccatgcctggctaagttttatccattctcttgctgatggatagttggactatttccggctttgagcaataatggataaagatgctgtgaacatgcatgtgcaaaccaccttgtggtcctgtgtttgctttatttctcttgggtaaatccctcagggcgggattgctgggtcatatgtatgttttaactgtggaaagaactgccaaatcttttcccaagtggttgtattcttttacaccctcacctgaagtgtatgaaagttctaactgctttgcacctttgccagtacttgctatagtcaatttttttgtgggatttaaattttttttgccattccagtatgtgtataatggtatgggtttctcattggttttaccttgcatttccctgatgattaaagatgttcaatattttttcatgtgttgattaccatgtgaagtgtttgttcacatttttttttttttttttttttttgagacagagtctcactctgtcgcccaggctggagtgcagacagggtttcgctatgttggccaggctggtctcgaactcctgacctcgtgatttgcttgccttggcctcccaaaagttctggaattacatgcgtgagccaccatgcccggccggattcggcaactaatttgtacatcttaaagctcctacaagtttatgacacattattatatggcagaaatagactaaaaataactttctgtgcaaaaatagttctggaagtcgtgtcacagggctcttggcccagcagggagccacttttaactagagctaaaagccagcattgtaaatagcatagaattgactgtaaagaggcaaaagggaatgttttgggatgatggaagtgttctaaaacttgattatgggggtagctgcaaggctatataaattcacagtggtcacttaaaatgggtgaactttacagtatgtaagttacacctcaagaaaactatagtaggaagaaagggagaagggggaacgagggaggagaggaaaggaaaaggaatagaaaagcaagcacaaatataggagggcattgttttgtaaaaacccatttcagctacagaaatatgtacattgtaaatatgtatttctaattgtggagttattaatgatctaaaacgttggaaagctcctgctccaagggaatgacatctagggcagtgctttgcaaacttgatgggaatcccctggggatcttcttataatgcatttcatattcaataggtctggggcagggactcagagtccacattttgaacaagtttcagctcatgctgacattgctggtctgtggacctcacttctgagtagcaaggactagggcataaattgaggctgagctattgagaatacacaaacttaatactgtcattgttggaagggtctttagaaaaatctagtacaatatttcccaaatggacatcatcatgagaaccttctaggggtacttattaaaaacacagattcctataatcaagacagtgtgatactggcataaggatagacaaacatatcaatagaagagactgcagagtccatatatgagtaattgaatatttgacaaaggtatcaagataatttaatggaaaaagaacagtcttttcagcaaatggtgctggaacaactgaatatccatatgcaaaaaatgacccgtgattgataccttgcatcatatataaaaattaactccaaaatagagctaaacctaaagccataaaacttctagaagaaaatacaggagaggccgagcacggtggctcacacctgtaaccctagcactgggagaccaaggcgggcaaatcacttgaggtcaggagttcgagaccagcctggccaacatggtgaaaccctgtctctactgaaaatacaaaaattagccagaaattgcttgaacccgagaggtggaggttgcagtgagccgagatcgtgccactgcactccagcctgggcaacagagcgagactctgcctcaaaaaaaaagaaagaaaagagaacacaggagaaaaccttcatcaccttgggataggcaaggacttcttagaacacaagaagctcaaattataaaagaaaaaaattgataaatcaaaccatcaaaaattaaatcttcttttcttcaaaagacaccattaaaattaaaaggcaaataagatgaggagaaaatattcacaataaaaatgtcagacaaagaactgtgtccaggctgggtgtggtaactcacacctgtaatcccaacactttgggaggctgaggtgggaggattgcttgagcccgggagtttgagaccagccagggcaagatggtaggaccctgtctctgcaaaaaaaaaaaaaaaaaaaaaaaaaaaaaaaaaaaaactgaaaattagctgggtgtggtggggtacacctgtagtcccagttaccagggaggctgagccagtaggatcccttgagcccaggaatttcaggtgacagtgagctatgatgatgtcatggcacactccagcctgggacacagagcgagactccgtctcaaaaaaaaaaaaaaagaaaactattgaccaaccttcttgtgaataaaatataagcaaataaaaacatcttgcagctcagcaagtaaccccaaaaatgtgcagatgtgaacagaggctgggcacagctcacacctgtaatcccagcactttgggaggccaatgcaggcagatcacttgaggtcagaagttcgaggccagcctggccaacatggtaaaaccctgtctctacaaaaaaatacaaaaaaaaaaaaaaattagccggacgtgatggtatgcacctgtaatcccaactattcaggaggctgaggcaggagaattgcgtgaacctgggaggcagaggttgcagtgacccgagatagcgccattgcactccagtccagtgacagtgtgagactccgtctcaaaaaaaaaaaaaaaaaaaaaaaaaaaaagaaaagaaattagttgctggatccataagttaaaagaattttgaccttcttaaactccccagttgacttgtgacatgtttttaagcctggacctgctatttgcttgtgtgttagaccatgatggttagcagagaggtaaaatgattttaaatattttactaagtaatagtcacatgtgtctgaaatactgtaatttctgaaaataaggctagatttgtgaagttttattgccaagacaggctctgaaaatctttccttaaatgaattagaagcccagagttgaatatgttgttttagtctgtttgtgttgctataaaataatgcccgaggctgggtaatttataaagagaagaggtttatttggctcatgattctgcagactgcaagaagcatctgcttctagtgagggcctcaggctacttccactcatggtggaaggggaaggggagttagcatgtgcacagaccacatgcagagatagaggaagagagagggaggaaaggcatgtgctgggctcttttttacatccagctctggagggactctcatgggaactaacagagcaagaactctcattaccacgagcatagcaccaaaccctcatgacccaaactcctcccacctggctttaccaccaatcttggggatgaaatgtcaacgtcagttatccagactatagcatatgtgttacaggtttctgttgtgaagtgaaatatattttcctttgtaaatcatgcctttaagacaaggccttgcctttcacctctaggcaactgtcactccccccaccaatgtgttattctggagtcagactgcctgagtttgcaatgcacctctgccacttaaccagttctgtgacctcaggaaagtgtcttaatgtctcagtttccccacctggaaaatgggtacaataatagtacttactgcatagatttgttaggataatcaaataagtgtagacatgtaaagtatttagggaggctgaggcaggagaattgcttgaacccaggaggcggaggttgcagtgagctgagatagcgccactgcactccagcctgggcaacagagcgagactgtctcagaaaaaaacaaaacaaaacaaaacaaaaaaacagcatttaggactgtgcccgacatgatcaatgttgattattatcatcatcattattattgctatcctcattatcattatttctctaaactggctgttgtcgaaatctcttattaagctattttccatgcctcccaaattctttaacaactaaacttatggcttttcccccaagtctcctgaggctgcttcctatttctgcacatttccgcatacgatgccaaccactgttctcctggcttcctgggccgaaaacttcagatctcctttgactctctcctccccacctccattcagttgcctatatgtgtagtgtctaccttttcatactagaattatcctttcctttccattcagattctaatcacctctcatctggattattcatttatcgtgtagctgaaatgggaccgtgtagctgaaatgggaccgtgtagctgaaatgggaggacagggttcccgtgggcccagccctggacccacctgtgtgggataggggacaggagcagctgggaagacaggattgggtgcgggacatggacatcagcagtgtgagggacaggataaggaaaggacagtgagaaggcggctctgagaaggaccggccacaccttagggcctgcctgtatttgaaatgcctttattagcttttgcatattcctcacagacatctctttgcatacaatgaaggtctttgggtgaattggatgaaatggcttgttaccagcttgaatgatcacttagaaaaaaactgcgcaggcctgcacggtggctcacacctgtaatcccagcactttgggaggctgaggcaggtggatcacttgaggtcaggagttcgagaccagcctggccaacatggtgaaaccccatgtctactaaaaatagaaaaattagctgggcatgttggcggatgcctgtaatcccagctacttgggaggctgaggcaggagaatcacttgaacctgggaggtggaggttgcagtgagccaagattgcaccactgcactccatcctgggcagcagagtgaggctttgtcacaaaaaaagaaaaaagaaaaaaacttgagaaaacattttaccctgttccttctctttatctttgtttcttacatttagtgaccatattggctatgtattgtgtgcatacaaccatcacgccctgtccttagcagagaactccaattttgaaacctcagaaggtggatactgtgctcgatgaaagtactcagtgccatattgatgagcggaatgttgggttaccttgggaacacagacgtccttccttgttactataaaaagggccacagtggctgtggttgtaaggcaacctacattttactgattctttatggtaaaaacgtgcctgtagggaaatgctgtatttttttaagaactttgatcagatacatcagacttccttttagtgctgatcaaatcaggtaaacccagttttcagtacttacgggtttttacaagtatcaaagctgtttccatccatccttcttctcctctttcctgtgcccacagtaagtaggcaggatatttgttgtaagactcaatatgaattgttttcaccaacagggattatgactaagagtataatttatactaatgtccttaggaggggacttatttgcctggtagggcctgtataggtcatatgaaggcagatggcgtgtgtttgacctcctcagggtggcctgttgagcagggttgcctggccaagtaagccttcccactccagattgtgaggcagctcaatgtgtttgcctcgcttgcaggttcctaccatggtttcactgtactgccatctgggaaaggaaggttggtgcagtttattccataataattaaaagccttaccactactaataaggcgtttagatacagccctactggccgggtgtggtagcttacacctgtaatcccagcactttgagaggctgaggcaggtagatagatcacttgaggtcaggagttcgagaccagcctggccaacatgtcaaaaccccatctctattaaaaattcaaaaattagctgggcgtggtggtgcgcacctgtaatcccagctactcgataggctgaggcaggagaattgcttgaaccagggaggcggaggttgcagtgagccgagattgtgccagtgcactccagcctgggcagtagagtgagactctgtctcaaaaagaaagaaagagagagagagagggagggagggagggaacaggaaggaagggagggagggtacagtcctacctaggggaacaaattatgcccattgatgctgtcaaacacctatcagaagtttactaattctctgcgattgaagaattattttattattgctaccatttttaacaaagccacccaaatgggaatcgtgtttattttctttatcgttttctgaggttttatattactaccgtatattgatgtggcatgaaccaaggtgtatacactgtgaagaaggtttttttattcgtcacatgcagtgtagcttactacagcaggcttccttacccttggcactactcacttttggggctggatgattctttttttttttttttttgtgagtcttgctctgttgaccaggcgggggtgcagcgatgcggtctcagctcactggaacctccgcctcccgggttcaagtgattctcctgcctcacactcccgagtagctgggattacaggcgcgtgtcaccacacctggctaatttttgtatttttggtagagacagagtttcaccatgttggccaggctggtctcgtacccctgacctcaagtgatccactcgtctcagcctcccaaagtgttgggattacaggcctgagccaagggctggatgattcttgtttgaggctgagggttgtcctgtgcactgtagaatgtttagcagcatccctgacctgtacccactagatgccagtagcacctccccaggagatattttggagtctcaaaatatctccagactttgccaagcactggggtacacagtctcccctggttgagaaccacagtattagaatgtaaggattgtgtagcttgctatttttaaaggcagtggtcatctgaagcactagttttcggtcagctataatagaaatgtatgtattgacctttaagtatgacagtttggctaacttaaaataatgtggtaaatccaaaacccgattgctgtgatgtgctagcatgcttaaatagcaacagcatattgctgttctttgatgatcgtttttacagatgaatggcaacacacaggatttgaaaatgcatatatcatttatttttatgttcctgaaatgaaaaggaaagaaatagtgacagccacaacagcccaggtaccatccatactcaggcatacctgtagtgcacatgggaaaagcacttttcctatgtgttattttggaatggcagtggccttttctgtggaatggccaaaagagaagcttgtacatgtccataaaccttgggaattctcccctgaaggcctcgttgttttacttttcacaaatctttcccagaaccaaatattcagttccacggtttaccttttcttttgtatcataatctgtagttttactattttcaaaatcaacttttaactactggcagcaataaattgaactttaagattcatggttcttttgttttccaaagagggttttagcagggatgcggttagaggctggaggtgggttagatagaggtaaatttaattgacaagctagagataactgcgaggctgtttaaaaggccaaccagactgccctgaacaatgttgaatgcggttacacattgtactctgcttttgtggtttaaaaataatctatctgtggccgggcgcagtggctcacgcctgtaatcccagcactttgggaggccaaggtgggcagatcacaaggtcaggagttcgagaccagtctggtcaatataatgaaaccccgtctctactaaaaatacaaaacattagccgggtgtggtggtgtgcacctgtaatcccagctacttgggaggctgaggcaggagaatggcatgaacccaggaggcggaggttgcagtgagccgagatcgcgccattgcactgcagccccgacaacagtgcgagactccgtctcaaaaaaaatacaaaaataataatctatttgtgccatgaagctgtttcctcaaggcctcaaagtgcccttgaagattgtccttgtttaagaattatgttgtggctggactgaggatgccagacgcacagatctgtaggcctaggatgggggtaactctgctgggcatgtttttcagagacaaatggaaatggaacaggggttctaactttcaaaatcatttttaacctgtctcccaattgttgtaataccaagagttttactctctaattaaaaaaatattttttgtagagacagggtcttggtatgttgcccaggctggtcttgaactcctggcctcaaacgatgctcccactttcttcctaagcactgggaatacaggcatgagccactgctcccagcccaaaagagtgattttttttcctagcccctttatttatcctttgcattttgttttaaaactaaggaatcttcttgaaacggaagccagctggtggtaggagcaggcctaagcactaccctgatgacttgcattgctcttcagtagccttgtcagtggcctctggactcagtggtgtaactgggaccatctcttctgtgggctggaattgccatgagctaagttggaatagcagggctaggagagcaagcagttcacattgggtagtttgtgctcagcagtgattaaagctcagatctgggccgggcgcggtgggttatgcctgtaatcccagtactttgggagtctgaggcgggctgatcacctaaggtcagaagtttgagaccagcctggccaacatggtgaaacttcgcctctactaaaaatacaaaaagctgagcgtggtggtgcacacctgtaatcccagctactcaggaggctgaagcacaagaatcccttgatcccaggaggcagaggttacagtgagctaggatcgtgccactgcattccagcctaggcgaccgagtgagactctgtctcaaaaaaaaaaaaaaaatcagatctgatgcccagtgagatggccaaggaagagttgtcagcctaggaagaaggggctgtcctcagggaaggggtctgaagggtcctgttaaccctgtaacagtgaggttggagggaccccaaacaaccacatacatgtaattgtgcagaaacagaaacaaggaatgaggacaatataatcagcttgagacaaagagcttgcagttggcttgctcatactcaagagtgcagcttgtcctatggtagggacctggggccttatgggcatctgggccaggagtgccatggagattggctggaaaggtctctggtgagcctttgggatccttttttctttctttttctttttagctatctccctataggaaggatgagactcttttacatcttttactttcatgttattaaacacacatacacatcaccatgaatagaaatcaaatgacattgctaatactggaaactccacaggtaatttctctttaccagtcattacctgctgggttctgtccacagtttaaaagagatatttgtacatttcttgtgctttgttgctgagaaaaagcaacaagcttctaagcaagagtcatttatccccgtgtcttggccctctttccagaagctcaaagcctttctgagtcttgtcttggattggtgagttgggagcttgtattttcacatgacacaaccctcattgagcaaccgcttctcctgatatgtaacctgaaagccagcctctgccccaccattacaggaaaatactggctgggttaggctgaggaataatgatgcctgacatttattgagcagtgcttgtgtagcgcatagtgtactgagcagttccctcttttccctcctcctgtttgcatcctttccctctcaattaatgctcctagtgatccagtgagtgggcgcgatctccatggggttagaacccaggctacctggctctggagcccctgctcccagggcactgtactcagctgccctctctgtacttgctgggggatgtgggggtgctcttcaagggtcattttgtctgcatgattggagccctttatcaggtgagactccagaagctcacgcaaaagccctgcatgtcagagcctctccatctctaaaggacctgaggccaagttcagatgcccagacctacatgccctgtccatggtagaaaactctacccttgctgccctgtccatgtttactgccttatctcattctagccccatttgcttgttggttttttgggatcaccttgtatagggtgggtagaatccacattcttgttgttgaagaacaggcatgcacaaaaaactgtgatgaacagaattacacagaaaggagagcatgaaggtggaggagagatgatcttgcaaccaccgcacagggaagaaggctgggaggacagacctcagcatagagtcacccgtattaccttagggagccctgagcttagctgtataggtttcttttaactagcaaatcatgctgtgaatagaatatgctgtgcatattggcttattttgaaattacatataattgtagaaacacaggaagctaggtaattcctgcctcccagatgaggatccagggtgggagctaagctttcatatcatggtgcccggtagataatcagttgagtttaatttttctagactatgtcttccttcgctacctttgagtttgctcatcttagcttctaagcaaactatcagcttggcagagaaagccttagaatgaaaactgtgacctcttaggaagttgtggggggtttcctggagtagttttatggggttcttgggaagactgaaatgattccaggatttggggcccagtggtcatctgccccaacttgttttgtctgtgttctcttctatcatcaggggaaaggagccaactgtgaatactcctgcatgccaagcattttcaaaaggtcttgcctctaccccataaccttgggatgtaggtagtaatgttcctattttatagaagaggaatttaaacctctgagatgttaaggaatttacccagtctcttgactaggatacagttgggcaggccacatggatggagccaagaagaagctctcagggccgagggggctgagctttatctatgaatggggagaaaatccaattgaggcagttttactgtagctgtagaaagaaccaggcctttggggcatttgtagctgggatctgatgtagactggagacagttaaaagcatgagaaagtcaggttaacagttaccctggaagataacagctgtcaaggaagagttcaggaccaacgaaccagcttcttagatttccttatcttctggtaaccagcaaggttaggcctttttgccatgctctttctcttcagccactgcctgggcctttgcaggtgacttcagttcccatgctggccctggcagaaggcatacctcctatttcccatgctgcccttggagtccaaatacaccccacttcttcacagggccacagtgaagatgtggttacctgggagttgccgggttattcttcatagctttgggcactaacaacatatggcaggtggtcagcactgaattttgccttttctgtttgttgctgtagttgttacagctttgaaaataggtataaattacatacactacaatgcacaaattttaagtctactgtttgatgagttttggcaaatatgtacactctcggggcctagcctacccaatgggtcccccactggaggcttggggcaagctgaagacattgctgatgtgaaaacaaggattaaagatcagggagggtcaggggctggttctagactgtggtagtagacatggtggtggtcaggtaatgagattaaggaatactcatgctttctggatactcaggacatatctcatttcagggccatatctaaaccagtaataatgatgataatactgttagctaatatttattaggcatttaatatgttctaagagctttgcatatattgttccttaagctccacattactctgtaacacaggtgctgtttaacagctgagaaaagtgaggctgagaagcttccccagaagtcacacttagtgtgtgctgagcagggatttaactgagctgggcagagcccactcctctttcttagcatcatccttcgtgcttcccagtaggaatagctaccattttctagatatctaggtctctctgtcagtgctccttccctttaggccctctcattattgagagtcaaccagactggcctcaaattcatgctttgctacttaatagctgtgtgactttggacagatttcttaacctctctgagtctcaatttcctcatctataaaatgggggtgcctcccacctcctaggagtattgtgagcattaaataatatttgtagagaataatgcctggccagaagtaggtgcttaggaactcatatttttagaaaaagacaatctagcccacaaatacgtgtacagtcctcaaaactaggcactgttgaattttataacttggcatgttgtcttttggttctggggagcttatttaccagattgagttactggcgcaggagttcctggggtggctgagtacatgtgtatgaatatagaataacatcatcatataccaccttcataattagtgtttgtgagatgtcatctctacgtactttttaaataagaaattacttattttgctgaagacaggatctctcatttctaccataaagggcgtgtgtctacatgtgtagacaaaaacaagcaaacaaacagtgattggtaactgatatactctttgcagaagatgagaaatgaagaggacatatacatgtttctagtataatttttgttggaaaagaatccttgccctagttttacactggcagtgttgtaatgtactctatcttatcacccccattaggaaaggtagcctgattgaggtttccaggtgtgtgtgcagaggccctccatagtggaaggtggagaacaataaataggagcatgtgcattagaatagccaacgcagaatagctggatttgttgagctcctattgtgtgctggatacagttaagcagtgcctatatctcatttaattctcactctatgataggttctactcttatctccattttatagaagaggaagcttagagcaggtcctgcggaactttcctgttttttttgttgttgtcgttgttgtttttttagacagagtcttattctgatgcccagggtggagtgcaatggtgcaactttggctcacggcaacctccacctcccaggttcaagcaattctcgtgcctcagcctctcgagtagctggtactatgtttatgccaccacacctggctaatttttatatttttagtagagacggggttttgccatgttagccaggctggtctcaaactcctgacctcaggtgatctgcccacctcggcctcccaaagtgctgggattacaggcgtgagtcactgtgcgcggctagaactcctgttgtaccttcttctgataaccgtgtgtagaggattttgtggcagaatggtgatgattacatgccaagttttggagtcgggggtcaggggagggatccattctcattattattatttgaccttgatgtcaaagtactatgcactttgtattgtttgggcttcgcccaattctacatttggtggggaaaatggcccttctcttagctgtgcaattgtgatttaagaaaatcatttaggaatcatttgaattgtttagtaataatcttacatgtctgcatttttctggaaaatgtaattcagttagctgttttaaaaggaaacctatgggaatttagtgggcatattttataaaaatctattaacggcgtagatttgtatatagtcttaaagtagttccctatttctccacttctttcttttcaaggactttttggcatctgtatacaatttttttttttttttgagactaagttttgctcttgttgcccaggctagagtgcagtggcgtgatcttggctcactgcaacctccacctcctgggttcaagagattctcctgcctcagcctcccaagtagctgggattacggtgcacgccaccacgcctaatttttgtatttttagtagagacggggttttgtcatgttggccgggctggtctcgaactcctgacctcaagtgatccacccgcctcagcctcccaaagtgctgggattacaggcatgagccactgcgcccggcctgtatacattttttaattgtctataccttttggatgtctataccttcatcctagtagtcagtagttattgaacttaattcctagttctagacttgcctcattcaaaagtatgaatcatgacatctttgaaaggggcacgttgcaaggaatgaattgggtgataatagtgacttattatcaccatttaagagaaaatttaagccagttcagaaaattatagcaggtaggaaatggattagatcattcattgtcagagcgtggtccctagactagcagcatcagcatcatctgggaatttattagaaatacaaattctcaggccccaccccagacctactaactcagaaattctaggggtagagcccagcaatcagtttttaataagccctctaatggattctgatgcacacgaaagcttgagaatcattggattagaaccctcccccacccaaaaaaatgctcggaagagttattaagctattgcaagaaatggcatcttcctgagagacaaatttaagttgaaaccacctggttctgctcttgtcagagatagaaaatggaataaatggccactgataggtctttgtaaccatatgattcccctgaggttagttcctgcctaggtatttgtttccaaaataagtatcccaaataaataccagaacttcatgtaatagtcgaagaaatagaattcagtagtcaaaagggattaaaagcaatttgtacatttactggagactagaaaagtgtcaaaagatgaattcctaatatgcagctttttgcctcgtcctctggctcccagtattatttgtgcacacacacactgacacacccacacactgtaccttccaagagtcacacaaaacccttccctcactcaattcctagtcagaactctccccagaaacagtccaacatggctcatggcttcctagtccctcatctctctttcacttccttctctcttttattccccccatcccccacccccatgcagcatatttttcccctttccagtgtcgattaatgaaaactgattcatttctcacagtcctggaaatctacccacatacattctccatctgtgtaatgaaagcccaataactgattcatattggatgggtagaatggaaaaagccaagaacataaagacagagttctctttctggtggagagagagatggagcagtctcatctctggttgaatggggcctcagagctgttccacctgaaatttcatgatttgggattttgaaagtgccaatcatacattaaattgactttttagggttttctttttttgcacattgtatgctggtatgattaaaccttcattttaacactgtttttgtttgtttgtttgtttgttttgagatggagtctcattctgtcacccaggctagagtgcagtggcacgatcttggctcactgtaacctccacctcccaggttcaagtgattctcctgcctcagcctcctgagtagcagggactacaggcacacaccaccacacccagctaattttttgtatttttttgtagtgacggggtttcaccatgttggccaggcttgtcttgaactcctgacctcaggtgattcacctgtctcagcctcccaaagtgccgggattacaggagtaaaccaccgcgcctggcctcattttaacactgttaagggttgttttgttgatgttctcagagtgcctttaatggttatgaatttcattttgaagaaaaattaggttgctacacaatttcgctgttggttttcatcaaaagtccattgtattaaagcactcatcctgagttatggagagaattgagatttagccctacactgaaagaaatttaaatgggaagtttagtgaccttatgggattgtaattggttttgaggttttaaatgaaaaatatgaggcgggagtatgtgatgctttccgaacaaaaacaatataccctcatgcaataatgaaaaaggttctagattctgtcagttgattttcagtttccacttgcaagattgaaaagttcaattggatttcaggctttattattttctagcatatttttgcataaatcattacccttgcctggaatttccaactcctgcctttcactgatctgaatctgaccccacctcctctctcccaggagagcagcagagtccagaagaaatcacactggattaaaagtcagagagataattagactcctcccacttaataggacattggatgggtgggtcacttgatgttttaaagtctccatttctttcttttttttttttttttgagacggagtttcactctcgttgcccaggctggagtgcaatggcgcagtcatggctcaccgcagcctccgcctcccagattcaagtgattctcctgcctcagcctcccaagtagctgggattacaggcatgtgccaccatgcccggctaatttttctatttttagtagatggggtttctccatgttggtcaggttggtctcgaactccagacctcaggtgatccgcccgcctcggcctctcaaagtgctgggattacaggcgtgagccaccgcgcccggccggtgggttattttctagattaaagaaatgggccgggtgcagtggctcacgcctgtaatcccagcactttaggaggctgaggcaggcggatcacgaggtcaggagatcgagactatcctggctaacacggtgaaaccccatctctactaaaacaaaaaattagccaggcgtggtggcgggcatctgtagtcccagctactcaggaggctgaggcaggagaatggtgtgaacctgggaggtggagcttgcagtaagccaagattgtgccactgcactccagcctgggtgacagagcgagactccatctcaaaaaaaaaaaaaaagaaaagaaaagaacccctctaaaaataatggccagcaacatttaatgagcatttattatacgggaagttcttcccacacatttcatgtaaccatcacagcagctgtttatcacaacacatttatcatttattggcagtttttttcatccccttttaaaaataaacactcatttttcttccaacttgctaacatttatttttgctccccagttttacaaagtataattaataacaaagctgttgggattgtgtgacaaagatactttatagaaatatatatgatttttacatactcacatgtaccacataggtttgcctttggaaccagatatatcatctagatatttgggatgaaaaggaaaaacaggcaacctagaagatttgggagaaggccgcagataagatcaactaggctctggattttaagccttgttgtggaacactccctgatgtggtttttggtattttgctttttttggggtgggggggagcactacaaattcttttattgcaatataatttactaataataacattaatcattttgaagtgtaatctggtggcattttgtacattcgcaatgttgtgaaactgtcaccactgcctaaaataccatcacattttcatcactcccaaaagaaatcttgaacccattagtagtgtttcacaatgtctcccatccccttcattccttttttatggctgaacattatttcattgtatggatgtataacgccatattatatttatccagtgtgatggttaatttttagtgtcaacttgactggattggggaatacctagagagctggtaaagcattatttttgtgtgtgtctgtgagagtgttttcagaggaaattggtgtgtgagtctgagtggactaggtgggggaagatccaccctcaacgtgggtgggatcctccaatcccctggaggccaagacagaacaaaaactgaggtgctcagtatatgttactgcttccccttcatgaacttgacatttcttgagtgcttactgtgcacaaaacactgtgctaggccctttgggggctacaagaagaaatggaacatagccctgcccttaagaagcttgtatcctgatggatggactggaaagggagggttggcgagagagggcatcgggagggtagagtttcctgtgcctgagggtggtgaatgagagagggaaggacccgaatgtgaagtaaagaggaaaaaggtctgtgagaatcagagcactgatggaattcaatggaaagattaatctgtgtgtgtgttgggggtggggctatggggagcagctcatggagtgccttcctttctttacccttgtattcctcccacaactctagcagaaaaatgggtacaaagatgccttaaaatgttggttgtttttatagacacttctggtatgaggttaaaatattctgcaaattgggaggtttccatcaatgggacataatattcgtggccctttgattcagcaactttttgagtccctcccagtctttagggtgccagagattcagagataagacaagagtttagaggacaagggtcaaatgaaaagacccaaagcctggcagggtggtgcacacctgtaatcacagcgactggagaggctgaggcaggaggattgcttgaggccaggagttaaagatcaaccaggggcagcatagtaagacccagtccccctgcccctgccttccacctccacggaaaacaaaacaaaacaaaacaaaacaaacagacctagacagtagcatgtaggacagtaacaaccttggcaaaggtaaacactgtggaggaatgtggcaggtgatcagtcattccttctgcagactgttttggggctcactctgctgagctctgtcatacagagagtagccacagggagggccctgccctgtagaatcaccataatctagaacactggttctcaaggtgtgggccctggaccagtagtgtcagcctcacctggaagcttgttagaaaggcagattctctggctcaccccagacttactccatcagaagttctggaggtgatgtccagcagtcattttcacaagccctccaggtggttctgatgcatgctcaagtgtggtgagcagtgggctaggacagttgtcaggtctggatgcacattagaatcacacgcggggcttttaaagcaacagtgcctaaaccacacctaagactgactagatcagaatctgaagggagacccaggcatctatatttttgaaagctctccaggtgattccattgtatagccaaagttgagaagcggtggtctccacatgcttaaacagatcatcacagtgcaaccaagagtgaccattaaggtgggaaacagtgcctgtgagtccacagagcagaggatgcctggcaaccccttgaagggatcaggatggctccccagaggaggtgaggacccttcattgtatttcctattggatgagctcttcattcctccttccctttttttctggacattgcagttgcacaaatctgagtgtgatcggaaaggttattttaaaattcatttaatgtgattaatttttcaaagttgaacacagctggcttccctttaaaactttgtattttgatagtggttcttaccatgaataattgactaatatcaggtcattaatattctataggagagtacttcaagctaataaaattcattttaaaattagtttttaaaaatgtgttcctgcagcccagggatagtaggatctcagtcaagtatgagattttatgcttttctgttaacataagatagttgtttgactgctcagtatccctgttttattccaatttttttgtaggaattaattgcccaggaaaagacctctgtttcagagttgcaagtttgcctggatgctgttgccctgggaaacattattgcatcaacagtggggaaggggtggctctgacatgggtgctctttgtccttctcctgggtagggcatctctgagagggtatcccctttaggtccttcccagggcttcacatttgggccagatttttttaaaaaataattaaacttttgtattttgaggtcattgtcaatccacacgcagctataagaaatattataggctgggtgcagtggctaatgcctgtaatcccaacattttgggaggctgaggcaggaggaccacttgaggccaggagttcaagatcagcctgggcaacatagtgagactgcatctctacaaataaataaataaataaataaataaataaataaataaataagaaaaaaattgccgaggccaggcgcggtggctcatgcctttaatcccagcactttgggaggccgaggtgggcagattacgaggtcaggagtttgagactagcttgaccaacatggtgaaaccccgtctctactaaaaatacaaaagttaaccaggcgtggtggcgcatgcctataatcccagctcctcaggaggctgaggcaggacaatcgcttgagcccgggaggcggaggttgcagtgagccaagatcgcaccactgcactccagcctgggcaacagagcgagactccgtctcaaaaagaaaaaagagaaagaaaagaaaaagccaagcatggtgacacatgcctgtagtcccagctacatgggaggctgaggtgagaggattgcttgggcccaggagttcgaggctgcagtgagctgattgtgccactgcactccagcctgggtgacagagtgaaaccctgtctcaaaaaaaaaaaaaaaaaaattacagagagagcccatgtaccctttacctggtttcccccagtggtagtatcctacaaaactatagaacagtatcacaactaaaatgttaccactgatacaatcaagacagagtacatttcatgatgccttttatagacatccacttccctcccacccctaccctctcaacccctggcaagcatgtaggcatggatctgttctccataagttcttatggagttcaaaggtaaaactgggtccctggttttaaaaaaagaaagagatggccatagactgtggctcatgcctgtaatctcagcactttaggaggctgaggcaggaagattgctttagcctaggagttccaacatcagcctgggcaacatagggagaccttgtctctactgaaaaataaaaaaattagccaggcatggtggcacatacctgtggttccagctacgtgggaggctgaggtgggaggatcacttaagcccaagagttggaggctgcagtgagcaatgatcgtgccactgtactccagtttgggcaaccaacagagtgatatcctgtctcaaaaagataaaaaaaagatgataaatgcacacaaatagggcacatggacaaaggatgattgggtaggaaagttagacattttaggatttcaggccatacataaagactttcttttggaactgaattcagcactgtattagtctattttcacactgctgataaagacatatccaagactgggaagaaaaggaggtttaattggacttagagttccaaatggctggggaggcctcagaatcatggagggaggcgaaaggcatttcttacatggcagcggcaagagaaaatgaggaagatgcaaacgcagaaataaaatcatcagatctcgtgagacttattcactaccatgagaacagtatggggaatactgcccccatgattgaaattatctcccaccagttccctcccacaacacctgggaattatgggagtacaattcaagatgagatttgggtggggacacagagccaaaccatatcaagcattacttcttggatacactgtgtctttagagggcatctcctggtgttagtgttcacagtaatctacctcaattcctctggtttaaatctggctgtgttttggtaataactggtttatttgttagaggccatggtttgtgctccagccctccttacctcggaatgagctcaagggctttttgacagcctttgggagaaacatgtagagtcagaaggtggaagctggagatgagttaatttggcttctcttggaatggatattctcaaaatgtttgctcaacaattaagcagaagaagcagatgctgtgtggaagaagctttactcatccagtaaatctcaatcccgactgaactcagacttccttatccacatgtgccccagagcagctagacgtgcagagagagaatcacaggagggagctgccaggcttctcactgcagggtggtaaccgccagccacatgtggctattaagcgcctaaagtgtgcccagtgtgactaaagaactgaactgtaactgtacttaattttgatatgaaatttaaatagccatgtatagctcatggctaccaaatgaacacagagattccacattgcccatgttgggctgtttgagtcactccacccctttcagtgggataaaactgaatttaaaaaagaaagagacggccatgcattgtggcatgagcaaggagaggccttacagcttcccccagggtcctctgtaaccccttccccacccagcatcagccctaaaacattgctgagcaaacattttcaaaccactagtgtgaggaggaagctgctaattagcctgcctggacaggagccacatctgtgtccagctgggccagcgcttggctcacagtactgcttacttcatactgctctaatgagtcacacttgacttctctttagatttgcaagctcattcttggggccaggttaagatttgttccctgcatgcatcacttcgttacagcactaagactaaggtgttacatttcttcccgtgccagggaagcagcacagaaaagcggtaactgagaatgtgggtcctttccgccagatgtgagagattaggaaaaaaaaatttaatggtttttaaagtgggtcctgaagccagtttcttgcattggaatctggcttcaagtgcctctgtttctacacctgtaagacaaggatcatcacagcacctctgtcatcatagggtggttgggctgagaaagtctgagcagtgcactttgtccttgggaactgctcagttattacctcttattatgatgatgctggtgatgatgactgtgagcatgataataaagattttctggaaagatgatttgaaggtgtgactctcatgtgtgtccatgagagggcagcctaaaatcatgcatgtctgtggaacaagcagcctctgtaaagcctcaaggtaatgtgggcagtttcaagtgtgtttggccctttttcttctctgtttttcttttttccctctgtttgaagagcgctttcagccattttcaggcttactttagatacggagcaggcccatgaacacctagagggcagcatgggcagtacagagctaggttcaggccctgcctgggtgggtgagtttgtgtaggtgccaatgagagcgtctgtctaggcgtcctaggcttttctttgtaacttttcacacagaactaattcttattaatcagactcttgaggtagacactagaacctgactgtgtttagagaaaaaagaaacttgattttctatgcttgttccccttccactaacttcacacctgcctctgagcattgtgtgcatgcattggtgccaccatgtaaggggacagtggccggagctgtatagacccagagttgcatcagccacacatggctctggaacacaccaggggagactgagttacagagagagcagaataagagtcctcaaaccatgtgggagcacagagcatcatagggctgggggacagtgggggtcttgaagatgggcagggtttaaacagatggagcagggtagaataaaggatggcatgagctagaaggtgcatgggagaaagggcagtgctgaggtaaagttgggaaaagagtttggagtcagattgcggggtggctggaatgagctgaggagttggcctttaaatttttgatgacgttcatattgttgatagtgtcataatgattaagagatgaccaaaaacaaaatgaagaatggcacttggatttttctagtacttatctcattttaatatccctgatatttaatctaggctgcaaaaccagatgtatgtggggaatcatgacaatccagtgtttgtcacgccatcccccttcctcattcccactgcctacactgtgggccaggccttcaggcctccctcctggacagcagcaggaacctccttagaagaagcacaggttgctgtggcagcaaggcacactatgatgccaacttgtgatgctcccagagaggaaggcacagatgctggggaagtgaacctggttatattaacatgaaagctgacttctaaagaatggtgtgcttctttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcaccactgcagtccgcagtccggcctgggcgacagagcgagactccgtctcaaaaaaaaaaaaaaaagaatggtgtgcttaaatattatatacataatatactgggtccagttgtaacagagtgcagtaaattatttgtaatcctaaaatgatcatgaagatccatttaatcttttgtttagaaagccctttagggttctgcaggggttggttggagatgaaaagctccagggatatttctcagacattttcggggaagttgtcatttgttccatcttatttgttgtagatatttggatgattctaagatactaagattgacattggcacaaacttggcagaaccaaaattgaacttgagtgttgtctttcatagtgctcacccaaggagctcatacgttggctcctttcagaaagtaggccgggcatggtggctcacacctgtaatcccagcactttgggaggccaaggtgggcgaatcatctgaggtcaggagtttgagactagcctggccaacatgatgaaaccccatctctactaaaaatacaaaaattagccatgcgtggttgcacgcacctgtaatcccagctactcgagaggctgaggcaggagaatcgcttgaacctgggaggcagaggttgcagtgagccaaggtcgcgccaccgcattccagcccaggcgacagagtgagactctgtctcaaaaaaaaaaaaaaaaaaaagtaaaatgttcagtgtctgtgtaatgagcagtattcaaaattttgtccatttttgtgcttctcctctcccccaggtggtcctgcttcaggcttgggagcctgactagacgaggcctagtgggcttctctgcacactgccaggcccgtctgtcacttactgtactttctgaccccttgtctgcctgggggcaaaggattaaggaaggggctttgtcctctggggctgatgttggcccaactacaggacagcttggcaggtgcatgcgaaagtggtagctgctgcccctcagctgtgtgtgtcatggagagtgacagattggacttcctttggttgaagtgatggagatggatgatgtgcacgtgcagtcagactcgggtgccatgcccagttgcctatagtacttagcagatagggaaagagtgaagaactgaaacataatctagttttctcctttgtaggcatggagggatttttgaaatcagatgagaggcagagattggccaaagaaagacgagaagaaagagaaaaatgtctgggtaagttatgcactttggctattttggtccaagggagtggagatatggtggtgtcttttctgaagattcttagaaatttgtgaatgaatgggaactaggacagttgctagatgaacatgaagaatcaggcgtgaacctacactgcaactggcatgttcacaaataggtaattttcagaatagttcactcggcaaacattgaacctctgctgtgttctagccactgtgttagggtctgcagttacgatattgaagaaagagaaacagtcgctgcccctgatctaaggaagtcctaacaccttcaagtgtcaactgtgtacactccctcaggttctctcttgggaatctaaaagggccatcctcaggagaactgagaaaatcagcacttgagtcattttatattttaggacagagagccctggttgagaaaggccgtcttgcctcttgcaggctgtagacagattagtgcagagtgttcttcacaggatgctgagggagatagcgtttccccattgcattgagacaaatgaggagctttcaggttcttctcttcttcactgcctcctgctggtcggtacaagcattgcctcctccagggaacccttccctgccttggctaggtggaattaagggccccttagtaaatgccttgagggtaaggcaaattttgttcgtgtgttttaccccctgacttagctcagtgtctggtgcttggtgcacacacagttaaactgcttttgaatgaacatagccttataagcatcattgctcaacctagcatatagtttagccattatgcacaagtttgacttaatgacagccgtcatagtcatagctcccacgtggggaggcacttactgtgaacttcacggtcatcatcttgttcaatcttaacaacactgtgatgtggcaaacatgactgtccccacatcgtagaggaggaaaccgaggcagagagatgatctagctaacatgcttagggttacccagctagtggcagaggtaccagaaccctttatctcaatcactgcatgctaggatcctaccaggctctttttagggctctgctcttgcttccttgtttttggtcttaatccaaactgcatgggatgctctggtaatgacacctctcttctactttccttccccagctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggtaaggcccaggtgcaccctccgccaccttccagccccctcagcaggctgctcagagtgcctgggcatcctgcccagctctggggtaggagagagacctgccgtgcaccttctccttggtggctcccatgccttctttcagcaacatgacatgaaactcgaagcagcactgacatagaaccgcagagacttatccattcaactcaggtgttaatttgctgtgtgatcttgggcaaactggttggcttctctgggccttgatttgtgtgtctgtgaagtgagggttggatttggcagtctccaatgcctcttttagtcataaccttttctgactctaagactcaaagggtccctggtggtctagtagataggggaaaaaaaaaaagactcagaggagattgtgggtagcggctgggtgaggtgaatctgaggattacagatgggagttcatgcctccagggcaggcacaaggccagaacaagagcttgtgaggttgagaacaatgtgatcctgtcagttgctactggcaaattagtctaccctcaaataccaagatgctaatatatttaaagtttaatgtagttcttcgctttaattgctctttccagttaccttttaaaaaagaaatggcacataattacccctacagagttctttattactaaattttgaaaatatatttagaaagcatatttggattatagattttcttcacgattatatttttaggaggtaataaaaaccttatgtcagttgatgataattttttattcataaggtataatgattcatcttttagtatgaacaatatagaggtttggtaatctccaaccctataggatatgaagatgtttgtacaaattcagtattttttaaaatctctgaacagttgcttatcactatatatatttaccccttccttcttttttttttaaagaacacatacgaaaacacacacatagtcagacccatctttgcccaagaagcaccctttcatggtgatttctttcctcctcttagaaaatgaggtctaagccagtgtcttagctatggttcaccgttattggctgcagtctgattgctgtgccttcatctgctcccagttcaaatgtcagctccaatgccagctctaccactgagcagctggtggccaggggcaagtcacatgcccctctaactctgtctccttagcccaaaacagaggtagttacaggaattaaaagaggtgacttttgtaaaagtgcccagcaaagcacctagcacagagtaatcgttcaggaatgttacattctgtttagttacttcagctgagcttggctaaagcaaggtcaagagggtgctacccacaaaagcttatgaaacagagtcagtagatgggaaaaagccacagtataataggctgttttggtaacttgggacagatttctcctttcctaacttctgtgttaagagttgctggactcacccattttcttcccatcctccattccttgatgacttagagcttgtcctcttcttccatgatctctccattttgaaagcttgtcactgctgcttccaggaaggggtactgtgaagtcacataagacacttcccatgctctgacatatgcattgtcactgggggctgcttttgaggcaatttctgtttataatttttctctacagaacattagtgctggaggcatgttaaattaagtagaacagctcccccttcttggaggtgagggagttttatgccatatggttggtcctgatgcagctgaatcttttgtggtttcccttctgggtaattttctatttgtgtgcttccttgcacccctaatgtggtggagggaagcaggaggctgcccgaccgacccttgtcagcccaagctgagcttggttccctcttctccctgggcacagcagggcagggctgagggctgggcctcctgtggttgtgtagcaacccaaggaaacagcagcctccttctgccacctgctcctgccctcagggtcccaggggacccaggtgtagcttagggacttgccacacacaggctggcttgttagctacattgggtcggtgctctgctggcacagaggcctttttggcattctcgtgggtgacatttagggagaagggatcagcctgcattacggaagcccctcttcaaaggaaaccctctgcactggcccctatgattcaaggggagctctgggagggctgcagcctgctcagtgcctggctgtggatgttctccattctcttctcagtgtcagattgaagtctttttttttttttttttttttttggtcatgttctgtctctgtcagccagagaaaagcctctgcaggaagatcattcatcctatgcaggccattttacttctctagcctgttggaaagtgtttgttgcccaccaaatcctgcctctctgggtctgatacttaggagctcatgagaggcctgttgaccccaccccagccctgccctggctctgtacccctatggttgccatgatgtcactcttgataacccctcatgtctgtgccagggcagaagtgggtaccaccaatggcctgtctctcagaggtcttaagagttggcagaggtcttaagagtagtcaggcctgtcccagggaggggtcccagggaggggtggggtggttctactgtccacttgacaccctgaccttaaactcattctcttgctggaggccacctactccttaagttcttagaaccttcacgtgccacacagctcccaggaaccaagctaccagaacaagttcctgtcacctgtgttagggctgacaacacagtatgccagcccattctcagggcagtatagcttcctgaccagtggccctggaaaattggatttggaaaagccaacttcatgttccttatgctaaacagaaaagagaaaggcctctttctctttctttctttctttctttctttctttctttctttctttctttctttctttctttctctctctctctctctcttttcttttcttttcttttctttcttttctgcacacatccctgctgaggaccgctgggggtgtgtccctgcagtgtcatccccagaacacatgtaatgggccgggcatggtggcttatgcctgtaatcccagcactttggggagccaaggcaggtggatcacctgaggtcaggagttcaagaccagcctggccaacatggtgaaaacccatctctactaaaaatacaaaaattagacagacttggtggtgctcacctgtaatcccagttacttaggaggctgaggtgagagaatcacttgaacctaggaggtggaggttgcagtgagcagagatcgcaccactgcactccagcctaggtgacaaagcaagactctgtctcaaaaaaaaaaaaaagaacacatataatggcagttgaaaaggcacagccaccccctaccacccattcctgccagagactgctgtctgagtaacagtgtctggaatgtgccctgctggcaacctttaatactgttcagccagttcagcggggtcaccttggtcgtgattctccaagttcatccagacagatctaaagccagacctcaaggcatcaagtgtgaggctcgctccttccttctttccttccttatctccctttccttcctttctatctttccttccttcctctctttccttccttctttttttccttccttctttccttccttccttcctatctatcctttcttccttcctgtctttcttccttcctatctttccttccttccttccttccttccttccttccacccttccttccttccttccttccttccttccttccttccacccttccactaagccctacctaatagaggagattctagggacgaggatttgccttgccctttccccatcctctgttgatcatcagatgatactcaggagaaccagaacttggcaggaattgcagtatgcagttctgatatttattaatactgtttttctaatgtgatggaactttctcatgctcactttctgttgctcagcctttcctctaaccagtggctcttgcttgggggtcccatgaccagcagcacctgggaacttgttagaaatgcagattctcagcaggctccaccccagacctattgactcagaaactctggggataaaccccaggattttaataattcctccaggggattctcctacctgatctctcagatttgagaactattgctctaaatggtcctgataagaatcttcctctttaaattcagattcacttagctttggttaaggacttactgcatactagtcattatcaaatagacttagagtgatctggtgatgtaggtaagctcatccccattttataggcaaggaaactgaagcccaggactgcaatgttagctcaaggtcacagggataaaaagtgtcaggcagaggtgggatttgaatccttacctcctgattccaaatctgagatcctttctgtttcgtcatatgaaggaacaaaaaggtacacacaaacacgaggcaatactgacctattcaggactaaccttaaataagacttgtgcactggacaagttttgttttctatatgtatgaatcaccccattctgactttttggggttccataaatcctcttctcttagaacttgcttatcatctatttctcatcatctctccaaaagtgggtgatacaaagtgagtgtgtctttctctcagggacaactgtgttttcatcggcctcctcaaggtctgaaggaatgaatctccagtggtgggatttggagcagctcagtggactggggatggatggcaggggtagtttttctagaggccattgaaaagtccaggggcaggtctggctttcagtgagcactcattcccttacaagggtgccccccagatagctgatcagtggtcaggctggttcagtgaagctcactattctttcttttcattggtcccctagtagagaagggaccactttgtgaggtccttctggcatgtaggaaatctaccgtaacccacccaatacttaattcactctaggatgaaaggtttcaacacttcagttaggtcattggttaaatactttacgttaaaccgtataatgaaatactattcagccccaatctcgagtggctgtacttcaggcatcacatggcagagaagttctcttccttccaagccccagcttttatcaggcagactgccagagttggccatcatcgtttaatgggccagggtcgtgaggactggactctgccaaggcatgcatactcacgattgtagagtctcaggccaaatacaagagcacagttaatagctaatacaaatctaagagttacaggaggtaaaaatccccctttctgcttacaggtccctggagaggcagtctcttagcaaagtgctattcagagaaaaattatgtagaggaggctgagatgtggagaagccagatcctcatctcatccctctggtatagacagaagggataaatccagatacctattaagtgacctttatatgtttctagtaagtgtgacataaaggagcctttcctgatctttaagtcatggttactcagttgatgatgtcctaaattaattttgcttctgtgtgtatttttttaagccatgacaattgtatctttttgttttagaatgggctatgattagcccagttcctggagcacctcggggttgggttttatgagggcaaaagggtgtcattataactgctagctcaggccttctccagtggagatagggagaggagttggtatttgcagtgtcacggaggtggtggggagtgcagaattagagcaccttcactgcagcagcaaggacaactttatgaaagtaacaatttgggtaatacaggagagtgtttttgataaatactgttacgagagaagccgaagcctaatggttgtttttctcttctggttaaaaattactgggttctgcctccctgcctcctccacctaagtaactctgggaacgcatggatgcttttttttttgtggccagaaggttctttactcttgcctcttgaaaattttgaaatatgcaatattatcccagattactatatagcagaaaagcgtcacactatgtaaaacagttggttcccctttaagaagttctaagatgaaaatgcagctttgcaaaatagatctcagtgtcatgtatcaccccaaaaactcaaattatatttgcattaaaattttctcaaagcaaaatgttttatgcttttaactagaaaggatgctcttggttctggagcagaattccagctctcctggttagggcaaaatgccttgagataggcctcaaggagttaatgcttattgggcattattcctagggcagcttctccccagggaggggaggggacaggacacacggtgtttaggttgagagccagtgctagcctagccgcattgtttactctccacctactcagaacacgctggtgtggcagagagagcacgtatgcctgggttttggatgctgagcacagaaagccccatttggtgactcacactgtgcactgaggcagcaggtagtgtggtggggctgggtagttaatcttgttaacacttgccttacacgaactgtgtaggaacggctggaggcgatgatgcgccggtccctggagcgcacacagcagctggagctgaaaaagaagtattcgtggggagcaccactggccattggacccggaggacatgatggtgagtgtagggttgcccctgtatttcaggtcctgggtgggaaataatggagcaggcaggggattatgggcaccactgggtgtctccaggatctgggggatgctttgcacagcttttcagaggcaccactttcagatgtgatgtttaaaactgccaagattcctacgcatgcatttgttatgaaggggatctgtgcattcttcttgatagcaaacagcagttgacacaaaaactgggttttgagggagagcaaaagagaagactttgaacgcagagcccagtgagctgggcccagctggcaagcccagggttgttctgacttcaggggagggaaacggcaggaggctctgtcactggtccagatgcgatcaggaaaagcacagtggcagttatcctccaaaaagggctggactatttcctgctgcattttaaatttttgttgctttttcgactttgtttcaaggtgacttatttcattaccagttcaaactcatctttaaattttcaaatgtgtaatttaatatatggattgttactagtctctggatggcttttccttcttttcagtgtctcactacatttcagcgatcttagcattctattatgcaggaggtgtgtactagctctatctgagagcaaatggatttgtgtttacaggacagttcttgactttgctgtattgtgcttttcacctttgggcagtaaatatactttattttttcttttttgaaaagtcaacaacccatttcagttactttttctaatttcctaattagaaactaagaagcaacaagaaattgggacttttttcttttacctctctttgctctgattttttgctgtgtaggtgaatcagaaaataccccaccccctcctctaggtttagcagccagcaccctccctccggatgcagggaccactgccgcagctgccgagtccaccaacggtatatccgagcatcactgtgccatagcattttgtgataactgttctgatcatcctcccccatcaccatgtctgcgtcaagcacttttacaattggtttcttagtctggcctgtcacaatttttttttcctagcaatgtgaatgacatgcccatatttctttgttcctctgtcattatagagcggtgcatgccttacatcttagtgccccggagacatttcatcctcaactcactaacgtctgccttgaaaatcttgtcagtgttggatttttgcacactcagatctttaacaatctcttcatcatctgttgtagacattaagaagcagggcatttctgattacttctggttaccaaaacctgtaatcacccggagttctgaatggagaacttgggcttagtgttaaagtgatagattcctggagaggtgtttgagagggagtggtaggaattttatcagtgctaacactggtaatccaaataattagataatttggctttgtgcttgattttatttaataggctgtctgttttgtatacaggcctgggaaactcctctggtctagatcaagaacagaactagccaaactttgtttccatttaataatgactttagaaattcaatccatcttcaactggcaaagaaaaaaaaaaaaagctgtaaaagggatgcaatatttaccaacaatgcggaaggtcatattagcagtaggaatcaatatccttggtttctgacattcctttgacaatgaataatccttactgggggtgcttcgtaacagcagttttgctgcacaagcagagttacctctagtgtgggcactggctttccccctaagaaaggtgcaggggggctgggcgtggtggcttgtgcctgtaatcccagcactttgggaggctgaggcaggcggattgcttgatgtcagtagttcgagaccagcctggccaacatggtaaaaccccgcctctactaaaaatacaaaaattagtcaagtgtggtggcgggtgcctggagccccagctactcaggaggctgaggcaagagaattgcttgaacccgggaggcagaggttgcagtgagatcgtaccagtgccctccagcctgggcaacggagcaagactctgtcttgaaaaaaaaagaaaaaagaaaggtgcagagaggtggagtaatcacccactgggaatcagcacccagggcccgggccagggtgaaatgagtgcagtacttgactagagcatacaatttaagggagtgccaaaaatctcagtaataaagataaaataatatcttaatgtgatattttttaaaatccaaattaatgcaaaacaatccataataaacaacaaatttctaaagactggtgccatgctgagcacatcagagcctgaagcaaaagggaaaatgtgtactcctatatacgtggttttatgtaatttctaatgtttagttttatcaaaacattaaagtagtttaaaatatggaaaaattgaaaagagtattaaaactcatataatttcaactttaaatagttttatttctacacaaatcaaatttattgtacttttacttcagctttagttaattaaaaattaccgggccaggtgcagtggctcacgcctgtaatcccagcactttgggaggctgaggcagatcacgaggtcaagagatcgagaccatcctggccaacatggtgaaacactgtctctactaaaaatacaaaaattagctgggcgtggtggcatgcacctgtagtcccagctactcaggaggttgaggcaggagaatcacttgaacccgggaggcggaggttgcagtgagccgagatcgtgccactgcactctagcctgggagacagagcaagactctgtctcaaaaaaaaaattatttaagattgtcatttggtcagcagaaattatagaacatcgcagttcttatggcagttctcatgggaaaacacgatgagcagaggagtagattttgaaaatattattgatgagtttgcttttttacaaccaagagcacacatttttcttttggcctcaggctctaacttagcttggcagggcactgtcagcatctctttgtttgccgtctgaaataatgactggaacgtaagaacaccaaactcagggtcgcctgttaaaatgctaacctcaaacagttaaagcatttgcaaaaggaccattttgatctgtctcttactaagtaagaaaaggaaaaccaactgctaaagaggccgttctgctttaaatacaactctgagaggacggatttcatctctctccaacctgagctacagataaccttcataaaagagtcggtttcagcaagcggtgacagtcagaccatagggcgttttccagtggtgatttgtctctgggtccaagttggttttgtttttgtgtgatgtgagcatgctcaaaaatccctagacaaaagaaaatgatttgttggtgggattaacacggcttcagttgaacagttgagtgaggttgaacatttgaaattgaagatgacaacacagtgaagaagttgcagagattttgctgcagaccaagggctgctgtagcctggtcatttctagagtaggataatgagatgccaggatgatgaaagcagagcatgctgtgccacagcatttaggaggtgcgtggatgaggacaggaaggacacttcgggatatgtgtttcttggttctacagtagtgtgatgaataccaatgtctttaatgcatttctctgcagcatgtgacaaactttcaacatcaactatgagtttgccaaagccaacggagcctcccatgaataaacgcctgtcttcatccaccgtggcaatatcctattccccagaccgaggcaagtgaacatgtagacttggtctctctagtttgtttcttttctggtgtgagcatcttaacgtttgtctttgtgagagtctcctcttgagccttctgcagataccgtcattgtcctagtcttgtggtctgaatgtgggagctctagggccttgtcagtgggactttggaacgtggcacggctctttagagccaggtcgttgttgaatagaggtaggaattaatgcagtctcccagtctgaaagagactgttctgttttccacattgcatgtaggagttatcctgcccaggaattaattaaccagtgggcagatgtgaccattaaagtaactgcctggtcaatgatggaatacagttgattagccagaaagagcagaattgataagttatagttatatgggaggcttagatatgtgaaaaaatggggttctgcagtcatctgtggtttataggcctgcccattttgtagatgaaaagagaagcacagaactaatgaggcctctaaaagaggaaaaggttgggtggcgctctgttttgagttaggagatgatgtgtatgggacgtgtgccagttccagaacctgagtagatttaacagggtctgcattctcacaaaggctcagataagtcactgaaagtctgtttatacctttcagagtatacaggttaaggaaatgacggaagctctccatgcactaaatgtttattctaaagcaacattgaagaagtatcaggtgccagtggagtgtttagcacaagttatcaccaagggcagagcaaaaggctggttgcgacttggcagaggctggtgtgccttcctggttgtttccactgacattgaccttgtacctctatcccagaggcatattatgtgtgtcagagaccctataaggttcataatgctactgatctgtgatgcagttcatggtaagcaccaggaacctggaagtgatgaagagctgaatacagagtgagggaaaagttaattcattgccatatataatacattcaaaactgatctaaatattttggtcattgacttccagattatgaatactactatttgtctttcattaaagctgataatcagttggctgtttgtatttttgtgcctctcacttaatttttacccttattgacatgtaaaaagtatgaaaagatatatttttatactattacaagatgacattttatttaaaaatcagtgtgttatgaaatgcttcttagcgcaggacctaaaacaagtgttttataggcataatttgttttctacttggagtaaaggtttttttgttgttgttttttttgttttttttttgtttgttttttttttgagacaggctctctgttgcacaggctagagtgcagtgatacagtcttggctcactgcaaactctgcctcccgggctcaagccatcctctcacttcagcctcaagtagctgggactacaggcgcatgtcaccatgcccagctaatttttttgtattttttgtagagacgaggtttcgccacgttgcccagggtggtctcaaattcttgagttcaagtgacccgactgccttggcctcccaaagtgctgggataacaagcatgagccaccatgcctggccataaatgatttcctgagtccatattacatctgggaggtgggctaattctctgagtgatacaggttactgtactgcaatagcatattgaatggattttggtacctagtgacaattaatgcactctcccaaactctaaaggacacattatttgttttattttacgatgacaaattccaaatccatcctttgttcaaatatttttattttccatgttctgccacccaaaagttaatttgcaccatgcattgtgttgtttaaatgttttattttgttttgttttaattttgctttttaaaattttcatttgattccatccctcagctcatcacatgcaccttagtccaatggaagccattcttgtttcgcgactgttgacacccacacagtcttctttagccagaagcagagcttcagtcatgctctctgggcaggccaatgattcaggtaaaagaggctaagctggtaacaccaaggaaaatgcccgaagaggtgttggtcagcctaggatttactcctgaatttttggattttgcttcctatttgctggctttgtgaaaagtcttcattggttaataacgtcttataccagtgttttgctgttttatgtttcttttgagtgtcacagaggtgagtaaattatcttatgagtgagagcatgttctttaggggaagaaaaccccacttgatgaactctggaggttagtagacttttcttaagagacggtgtggcaaaacagcctgtagaccagtctggggtgtcccatagccagctctaccactcactagctctcaccattgggggtaagttaattaacttctttaagcctcagttttctcatctataagatggagctattttaaattattttgaagattaaatgagagagtgcatgcaaatgagatagcacaatgattagcacagaatgaaagctagaaactttgagaagtttctagcctcactactcaaaaggtggtccatggaccagcaatggcagcagcatctaggagcttggttggaaggccccacctagcctgcacactgaagtctgagaaacactggaccagaccatcaaagccctgcctttatcaaagcagatcaagtcgtcatgtcaggatttgtggcggctggcattctctttgtttccagatgagcagcactgtgtccacctaaggtcaggtctactctctgttctccagatagtgtactcagttgtgatgatacataaatgagataaaacttctgcctagttgtagctgcttccaaacagttatactgtttctgcaaataagttgtacagatagctaataggttcataagatgctcaacatcattaatcattagggaaatgcaaatcaaaaccatagtgggatgccactttacacccactaggatgactagaatttttttaaaaggggaaataaccacgtgttggtggaggtgtggagacactcttccctcacacactgctggtgggaatgtaaaatgatgcagctactgtagaacacagtctgaccgttgctcaaaaacttaagcatagagttcccatacgacccagcaattccactcctaggtatacagccaaggaaattaaaaacatatgtttgcacaaaaacttattcacaatagccacaaagtggaaagaaaatatgatatacccataaagtagaatattattcagctataaaaagaaatacaggccaggcatggtggctcacacctgtaatctcagcactatgggaggccaaggtgggcagttcacttgaggtagggagttcgagaccagcatggccaacatagtgaaaccccatctctactaaaaatacaaaaattagctgggtgtggtggtgcacacctgtaatcccagctactcgggaggctaagacaggagaatcacttgagcccaggaggtggagactgtagtgagccgagattgcaccactgtactccagcttgggtgacacagcgagactccatctcaaaaaaaaaaaaaaaaaaatacagatacatgccacaagatggatgaaccttgaaaatgtgctaagtgaaagaaaccagttgcaaaaggccacatattgtgtgcttctatttatgtgaaatgtctgaaataggaaaatccatggagatggacaatagatggtggttatcagagactggaggagggaaggaaggggagtgactgcttaacggacgaagtttctttggggaatcttgaaaatgtttttagaagtagactgtggttatggttccacaaccttgcaaatgtagcaaaacctccaaattgtatgtgtatatgtatacgtatacatatacgtatacatatatgtatatatatgtatatgtatttaaagacagggtcttgctcttttaccctggctagaatgcagtgatgtgatcatagctcactgcagcctcgaactccaagccctcctctcacctcagcttcccaagtagctgggactacaggcacacaccaccatgcctggctaattttttgggttctttggagggacaaggtctcactatgttgctcaggctggtctcaaactcttgggctcaagcgcgacccatctactttggcctcccaaagttctaggattacaggtatgagccaccatgcctgtcctgtatactttttaaagggtgaattttatggtatatgaattatgtatcaaaaaaccctagcaagtaggaagtaccccattttgagaataaggaatatgttggggttccctaagagcaactccaggatcagtgatttgctaggaagactcacaggatccccagtgaaaggatgcaagcaaagtcagcaaaggagaaagacacatgggacaaagtcctgggaagaccaggcacaagcttgcagagtcctctctggtggagtcactcaggacgcctttcaccccagcaatgagttacgacaacatgtatgaaatgttgccaaccagggaagctttttagagactcagtgccaacggtttttacagagggctggtcacatgtactccatgcccagcacatacccaaattccaggttcccagaaggaaagcaggtattcaacatacaccatgttgtttgtttatgccctgtgagccactcaacagttaaagggggatcgtcctaaaatgtacgttcccaggtgctggctaaaggctaaccttgtaagcaggccttagtagggacagcagtcaggcttgctatgttaactcatttttgcacagctcacccacttgacccttggccaaggtgtctttacagaaaatttttcagtagggccccacatagcagggggtgagaccatcctgcagtattgatctcagttatgtcctttaggggttctgggacttagcagttaaagcaaatctcattaaccagaaggtctgtcttttttttctctctttcttttctttttctttttcttatttatttatttatttatttattttggagacaaggtcttgctctgttgctcttagccacgctggagtgcagtggcatgatcatggctcactgtggcctcaacctcctaggcttaagtgatcatcccacctaagtctcctgagtagctaggactataggtgtgtgctaccacacttagctaattttttttttttttttttgtagagatagggtcttcctatgttgcccaagttggtctcaaactctgggactcaagcgatcctcccacctcggcctcccaaagtgctgggattacaggcttaagccactgcacctggccttagaaaggtctgtttgaggcagccaggtggcctcctccatcagttgctgtatgaatctttttacctggcctgtggcatcagctcaggcccagaacagctctggccagtaagttgaaactgatctgaatgccttccaggcctgacgccgtgtcatgataatcgtggcacgcacataggaactatgatccccaagggctcatgtggttccctggaaaaaaagagttgaagatgttagggcacactagcagggtatcattggtcagtcagttcccagtgtggcctcccactgtggtgactggtgcctcagggtgctcagtccagtgcaggtaattcagctcagtcccaggttttatggcggctgcctgaggccatcagtcccaaacagttctaccagtgaccctacttcatcttcctggcaagtgcagatggcatctggagctgttctgtggggacatgtaggaactggccccactcctgccggctcatagtcatgctgtcacatgccatctaggctcagccatgggtctgagtccaaggtgctttcagcacaaggagttttccttcaggaaggagagcgcttccaggagcagttatggaaaacagaacacaaatgtccttccgtatccctgtatcatttttaccccaggtgttggattatgttgtttttctccatgtcctattcaataatcaaaactttacattttcttaatcatcccctactctcacccagacctttcaaagaaaggacaaaagcatttcttaaaacccatttttatccaacttaaccagaaagatatattgtgttcaggtattaggctaaaatcctaagttttcgaaacattttaaagtaggtttgtatcacctctgagccctttcatcttgatcattttatccagtgagcagcctagaaaagatcaatccctttccagtgacagctgcatttaacaaattgctttactgacgtgtgtagtgagagaaaggtagaggaaatatagtcaggatctcagtctattacaaactgcagctactccagaaaattaaacacaaagcatcaacagcagtgacactttccccagagggaatggagttcagtctgtcagggatggctgaaagagtcacattgcctgtggtgtgacttggagcttttgtaggaatcatgtgttgggaatataatcagactctgcatcagaaataatagagccaatgagcagcttgattgtggatggtcccatcagagaacaagccctgtcttgtgggcacttgtatgtgacccagtctagcagcatccagaatctttttacagttttgggccccatgaagggcattctatatttgtagtggtccctactcgatttttaaaactccagaagcatgtcttttcctagaaattgcctgtcttttcatatctccccttttcaagaggctccattagacaaaagtcatagcagaaaaatctactacagagacttgttctggttctaatatttggagtttaaattccagcctacccactgctggcaaaaagcaaggaggttgtgtctaactctcacttggaggagaaaacaaaaaccaaaggcatcacttgggctgtgctttttccctcactttagctagcatgctacagtcaaaagcagccagggggatccatcaagccaactctcttggagctgtattggtcatctttaaattccgtaggtcacttttacctctcaaaacagctcagctgctgttttataccatggataacttcatagccacccaggcatcacaagtttgttctccacccttttgtccttttcccaaaatgtgattttaccacgtttcagcaaatcagggtcattccagcaattcccatttctgacactagttgtgccagagttccccaagaccaccccaggtttgatgattggctaggagaacttggaagaatcagcatagttccacgcatggctgtgacttattttttctttcttagctttttttttttttttttttttttttcgagatggggtctttctctgtcacccaggttggagtgtagtggcgcgatcttgactcactgcagcctcaactttccaggctcaagcgatcctcctgcctcagcctccagagtagttgggactacaggagtgtgcccccatgccaagctaatttttgtattttttgaagggctgtggtttcaccatgttgccaaggctggtctcaacctcctaagctcaggtgagccaccatgcccggcccatggctatgatttattatagcaggaggaaacatgaaaaaactagcaaatggaggaggtgcatgggactaagttcagaagtaaccaggtgtggatttccaagagtcttcttccagtggagtcacatgggacgagcttaattcctctaccaacacattgtgacaacatgtatgaaatgttgccaggctgggaagttggctagaaactcagtgcccagggtttttactgggggctagatatgtaggcatcccctcccaggcacatacccagattccacactcccacaagaaaagcagatgcttagcataaaccatactgtttgtataaacagtttagacacccatcagttaatggtgggaaccctcctgaaatctaagttctcagatgccagccaagggccacccttataagcaggcctttccaagcacagcagtcagatctgctatgttaacccttttgtgcacaaggaaatcgatgtttagagaggttaagtaacctgcccaaggtgatccagctattaggtggcagtgctaggtctctgtggctccaaagtacagacttttaacccctgaaataaacttgaataaacttgactcttgagtatgggagcctttttagggtaagatccatcctgtgtacaatagaaaagtatgatattgattgcccaggtcatattttaacagaaatgtgttcttcccaactctctgctctactttttccatctgtactctctgtccttctggctgttatactgtaactttctagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtaggtttaaaaccacccacccactcactcctctagactgtgttctgtctgatggtgtgattacttctgtgcttgacctgggctgtctgtttccatcaatctcctgggactgctcaaagcaggaaagggtagatttagttcaaaattttacccaacctttgaaaatcatttaactttttgcaccctcttaagtcttagtaccttggagcaaattcttaatgatgtccttgtcacagcctgccctccagaggacaggagtcagaaggaatgttctaaatatcctctgtcttcctcgttacggatatctgattctgggtcagtcttgcccgtgcatctaagtggaactgaggatctacgtcaacttttacctacaaaagtaatcattaaatattcttttgagatgaagtctttttatgttgcccaggctgaccttgaattcctaggctcaagtaatcctcctgcctcagcctcctgagtagctgggactacaggcacatgttactatgccaagcttaaacatttttgatggcatactggcactatcagtaaattaaatgttgagaaggcacccccaattgtgtctatttatttagaaattacacagtgccatactacttttgttagttattgattgctacttaacaaatcacctcaaaccttggcagcttaaaataacaaatatctattaattcatgggttctttgggtcagaaattcagagtgacttagtggttctggtacaaggtctttcatgaggtgtggtcaagatgttggccagggctgcatcatctgaaagcatggctgggcctcatctgagacggctcattcatggctgttggcaggaggcctcggttcctcactgcatgggcctgtccataaagctgcttgagtatccaaatgatgccacagctggcttccctccaagcaagctatcgggaagctgcagtgtcctttaagtaagtcactaagatcaacccacactcaagaggagaggaattaagcctcacctgtcgaagggaggaatatcaaataatgtcaggacttatttcaaaactacttcattttataatgccatattttcttttcaaatctgttgtggctcttagaagtgcatgttttagactctcggattttactatacagtggattagtgttgaaagggattgatggatgtgagtgtgggggccaattgaggacttgctgcagaaaagtgtgatagggagagaagggagctaacccttgtggagcactttctgcaggctgggcactgatgtctgttcccttctgccaaaggaggtaatgggaagacctacaggactagatggggttgcagacccattataccatgtataccatcaggggccacagctcactgtcttggatgttgtaaccacattttcacccacctgtaatttttttgtagtgattttacatttttatactcttttcagttcctatatgtctaagaccgtaatatggttcagttgttaactctttgaaagacaacaaggagaaggaaatctttgcattttgaggctgattttttttaactggataatgcaaatgtgatgacctcatcctgcctccccgcaaagatgcctgtcatgtgaagcgttatagcttcatatcgatccctctgaaagaaagctgtgcattgttccatctggggtattagtcttataaattgtggaagtagtgccagtcatggactgtggctatcctgtgtcccctacaggtggagaaggtgaagcgggggcaacgaacagcaacttctcttcctgttgtgaacttcgggtcccctctgagaagatgtgagttttctggaggcattcctaagagaccatcttctcctgtgatatccaagtaagcatctctcccctttgccagacagtctgactgtcatgagtcagtttgctagggctttgtgccatccagtgttgcagctcctgctcccccgtgaggcgtggccagccagaagtggtaagtgggagaaatgctggccttggagttacgtggcttgactctctgtgtatcttctgggtgaaagatcctttgctaagggaccccagtgcgtaacagggcttttatttaccaagatgatgcattcagcattttctctttaggtccatgaattccattctgcttttctggtattctttttccagttgcatttggatttaagtgattgcattgggcttgggctcctcctgacattctcccccaccttgttgtctctctctttaatagagagacaataataacttgtcagccatgatcaacagtattttaatgaagcaaatatatatgtgtgtgtgtttttaagaaatggggtcttgttgggttgcccaggcctggagtacagtgactgttcacaggcataatcacagcacgctatagcctccaactcctgggctcaagtgatccccccgcctcagactcccaagtagctgggaccactatgcccatgcaccataacaccaccatgcctaatttttgttaggaactaggtaaactcaccaaggaaaccatgtaactgaaaaatttacaataactttgtgaccaccaaggtcttaagtcattaaaatattttactgacagtaactgacaaaagactcagtaaataactcagtccagtaggacagtggaaaccatctttagtaggacagagaaagaaagagaaatatgatttaatttgggaatataggaaagtttttatatggagagaatcatataaaccttattcagtgtatcagtttagttcagagaatgttggataaacacaagtttaatgaaaacttgcgaatttgtcaaaaatatttaaagatgacatcagctcttaaatttccaatgtgttgctttctaatagagactttttcactactattaataattttttttagagatcactatggttttgatacactactaatacctgccattgatgtgtttgtcctccataaggaaaatctttccatagcacatcactgaattaaaagcctacttttctttctttctttatttttagttcattgcaacctttctgtgctagtattgcccatctttggttatggtgttgttatcctaccacctctttaaatttattatgtggactctacgatccgtttccctctgtcttatatctgagcctttttcagcttccacccatgcatcattactctggtgttaattttggacatttgcattaacagaaagaaaagcctagtttacgctgagacttttacaggctccaccctctctctgtcttgctggaatttggactcatggtccctgcagggatactagcttgcaagtttcatcattattattgtaaatggtagtatcttctatagaaatgagaattataggtatacctagttttgttgtactttgcacttcgcaaatactggttttttttgttgttgttgttgtttgttttacaaattgaaggtttgtggcaaccctgcattgagcatgtctgtcgatgccatttttccaatagtgtgtgctcacttcttgtctctgtgtcacattttggcaattctcaaaatatccaaacttcattattattattatatccattatggtgatctgtgatcaatgatctttgatgttactgttataattgttttggggtgccatgaattgcacccatataagatgacaaacttaatgtgtgtgttctgacagctccactgacaggccattcccccatctccctctccttggatctgtctacaccctgagacagagtaatattgaaatgaggccaattgataacccaacaatggcctcttagtgtccaagtaaaaggaagtgccacagatctctccctttaaatcaaaagctagaaatgattgagctcagtgaggaaggcacatcaaatctgacatgggctgaaggctaggcctctggcaccagttagccaagtcatgaatgcaaaggaaaagttattgaaggaaattaaaagtgctactccagtgaacacacaaaccataagaaagggaaacagcctgtgttagtcagggttctccagagggacagaactaataggatagatgtatatataaaggggagtttattaaggagtattaactcacacgatcacaaggtaaagtcccacaatagaccatctgcaagctgaggagcaaggaagccagtccgagtcccaaaacctcaaaagtagggaagccgacagtgcagcctttagtctgtggtcgaaggtccaagagtccaaaagctgaagaacttagagtccagtgtttgagggcaggaagcacccagcatgggagaagtaggccagaagactaagccagtctagtcgtccttccacactcttccacctgctttttttttttttttttttttttgagatggagtcttgctctgtcaccaggctggagtgcagtggcgcaatctcggctcactgcaacctctgcctcccaggttcaagcgattcccctgcctcagcctcccgagtagctgggattacaggcatgcactaccatgcccagctaattttttatattttagtagagacggggtttcaccacattggccaggatggtctccatctcctgaccttgtgatccgcccaccttggcctcccaaagtgctgggattacaggtgtgagccaccttcacctgcttttatcctagccatgctggcagctgattagatggtacccacccagattgagggtgggtctgcctcttccagtccactgactcaaatgttaatcttcttggcaacaccctcacagacacacccaggaacaatactttgcatccttcaatccaatccagttgaaactcaatattaaccatcacaagtccacctcttgtcgacttgaacccatacacatctcctgagatcatacataatcttcaaataaagacaaataataaggtcgtaattacgcctatccttcctacaactggaagcataccaatccccaacccaaatgctattacataaagttaacacttaaatgctgatatgacatcaataaatcttatgtcacatgataaaggaaagagaaaggaaatgacaatagtttcttcatccaccatgaaggtggataaggcattccatgggtccacagatggtagtcttggcagaagcattgcatgcaggatagacaaacctatatccagagtaagggtatacatgcacaaacatgttcttaacaaaataaggaagaaatactcatgcaattacagtcctcgtttctgcaactggtcctgtgatcgtagctggtactgatgactcccttcttctactacccattctgtattctctttgccttcagcaaacacctcagcaggtcgttgtcttttacctggtggagtgacccaaagtttcactcctgaagggtctgggccatttgtagtcctgccaggattgggctcttgtagttttccattgaccttaatcacagggcatggtaaaactaagagatgccctaagggatctcctgtattccacgcatactctttcttacctccattgtggagtagtaaactgatttcatcttgatagtctgggtcaatcaccccagtcaacactaactgtcttcttagcctgttgagttagaggtaggaggagcttaaagtgtccagggggcaatctttgttgtatctcctggtggcagcattcctccctctggaactaagacctctaggccagcagaacgtaatgttgcgggaacaggaagcaaaaattttgctaatgggtcactaggggtgatggtgagtggtgccacttccatttccaccccttgattcctggacccgtgaatcctggctgtgggagaaacagtaccatgtataggacgttgattcagaacatacacagccttgtgaagaactttgccccagccttgcaaagtattgttacctaattggcattgtaattgtgacttcaaaaggccattccactgttctatcaatccagctgcttcaagataatggggaatatgttaagaccagtgaattccatgagcatgagcccactgctgcacttctttagccgtaaagtgagtgccttgttcagaggcaatgctatgtggaataccatgaaggtggataaggcattccatgggtctacagacagtagtcttggcagaagcattgcgtgcaggatagacaaacctatatccagagtaagtatctattccagcgagtacaaactgctgcccttttcatgatggaagaggtccagtataatcaacctgccaccaagtagttggctgatcaccttgaggaatggtgcatatcgagggctcagagttggtctctgctgctggcagattgggcactcagcagtggccgtagctaggtcagccttggtgagtggaaatctgtgttgctgagcccatgtgtaacctctatccctgccaccgtggccactttgttcatggacccattgtgcaatgacagaggtggctggggaaagaggctgagtggtgtccacagaacgagtcatcctatccacttgattattaaaatcctcctctactgaggtcacccgttggtgagcattcacatgggatacaaatgtcctcagtttttgaccactcagagaggtccatccacatatctcttccccaaatttctttgtcaccaattttccaatcatgcttcttccaagtccctaaccgtccagccaaaccattggctacagcccatgaatcagtatataatcacatatctgaccatttctccttccaagtaaagcgcataaccaggtgcagtgctcggagttgtgcccactgggaagatttcccttcaccactgtccttcaggaatgtcccagaaaggggctgtagtgccgtagctgtccactttcaggtggtgcctgcatatcatccacagccatctgtaaatcaggccctagtcttctcttcctctgtcaactgatcatagggaaccgcccaccaccacccatgaggccatcggtgcgggctgggggagagaaggcagggtgacagggcatttgagccacttcctcatgtaatttgcttgtgccctcaggacctgctcgagcccgatcatgtatataccatttccacttgatgatagaatgctgctgtgcacaccccactttatggctagataggtcagaaagcacccagttcatgataggcagttcagatcacaaggaatggcttccttgctcctcagcttgcagatggcctattgtgggacttcaccttgtggttgtgagtcagtactccttaataaactcccctttatatatacatctatcctattacttctgtccctctagaagtattttggtaccaggagtagttctagaggaacagaatattaaggatggagttctttcgttggttttggggtttctggagttggcttctcagaagcaaggtcacaactggctcactggctctgtgctgcttctttgaagttgaaaatccttttttttttttttttttttttgagatggagtctcacactgtcacccaggctggagtgcagtggtgcgatctcagctcactgcaacctctgcctccagggttcaagtgattctcctgcctcagcctcccaagtagctgggattacaggggtgcgccaccacgcccggctaatttttgtatgtttcgtagagatggggtttcaccatgttggccaggctggtctcgaattcctgacctcgtgatccgcccaccttggcctcccaaagtgctgggattacaggcatgagccaccgcgcctggccgaaaatctttttttaaaaaacttttattttagtttcaggggcacatgtgcaggtttgttctatagatgaattgtgtgtcacaggccaggcgcggtggctcacacctatagtcccagcactttgagaggccaaggtgggtggatcacaaggtcaggtgtttgagaccagcctggccaacatagtgaaaccccgtctctacaaaaaatacaaaaaattagccaggcgtggtggcacgcacctgtaatcccagctactcgggaggctgaggcaggagaatcgcttgaacccgggaggcggaggttgcagtgagctgagatcgcgccacttccagcccaggcaacagtgcaagactccgtctcaaaaaataaaaaataaaataaattgcctgtcacaggggtttggtgtacatattattttgccacccaggtaataagcatagtacccagtgggtagttttttgattctcaccctcctcccacgctccaccctcaagtaggccccaatatctgttgttcccttcttcacgtgcaagtgtactcattgtttagctcccattaataagtgagaatatacagtgtctggttttctgtttctgcattagttcacttagaataatgtgaagtcgaaaatgttgaagaagattgtgtttctagaactattttatacacacacacacacacacacacacacacacacatatatattttttttgagacggagtcttgctctgtcgcccaggctggagtgcaacggtgcaatctcggcccactgcaacctctgcctcccaggttcaagcgattctcctgcctcagcctcccaaatagctgggactactggtgcgcgccaccacacccacctaattttttgtggggtttttttgtttttgtttttgtttttagtagagatggggtttcaccatgttagccaggatggtctcaatctcctgaccttgtgatatgcctgcctcagcctcccaaagtgctgagattacaggtgtgagcaaccacgcctggccaactattttatattttaaaggacacatcatctgagttttgtaaaagctgtccctgatcaaagggacttggttaaaattccagacttttttatgcagtttaatttagagaaaaaaaatttaatttccactctgtctagaacactagtaggcacatagtaggtgctataaatatttgtggaatgaatgaatgcaggtcactatgcccagtgcctcagagaatccccaaatgagtgagaacagtccctatttcaaggaacctccagcaaggtgcggggagccttgtacacagttgagcacagtacaggccctaatccaaagagccgcccatctgctcaggactctgctcagccatcatcctctccatagccagccaaagctgaattcacccccttctctgtgttgacagagcatcatgtgcagccctctttcattcactcacttaacatccagccctcttctaagggctgaggatgcaaaagtccctaccctcctggagcttatgtgacagtgaacagcatggataagatcaggtggcgataagcactatggaaaaaaaattaaaccggttcagatgacagaggggtggaagggagtagctggataaggtggtcaggaaaggattctctgagaaggtgacattatagcagagccatgcaggaaactagggcataggcggggttggtctatgcctcattgcttggtgttagtattttatacttagcaatctcctgctagactgctatgaggttgggaactgtcttgatttattgttgcacagtaggtgctcagtatgtgtgtgtgttagtctgtttggctgctaaactgactggcttataaacaacagagatgtatttctcacagttccggaggctgggaagtccatgatcaaggtatggccagagtcagtgtcaattgagggcccatttcttgattcatgaacaaccatcttctcagtgtgtcctcacatgatggaaggggcgcaagggagctctctggggtctcttttataagggcactgatgccattcaggaggattccaccttcatgacctaatcacctcccaaaggccccacctcctaataccaccaccatggggttagggtttcaactcacatgttttgaggagacagaaacattcagacatagcagtggtatgggatgcaactaagaagggaaggagaagctggggggcaagggcagggtcacctggcagatagggaaaatgttgagaccaaacctgctcaaggactttgccctttgttcactcctgagctcaaatgacccacctgcccctgcctcccaaagtgctcaggttacaggtgcgagccactgcacctggccagttatatcattctgtttttttttttttttttttttttttttggagacagggtctcactctgtcgcccagtctggagtgcagtggctcagtctctgctcacagcaacctttgcctggcaggttcaagcaattttcctgcctcagcctcccaaatagctgggattacaggcatgcaccaccacgtctggctaatttttgtatatttagtagagacagggtttcactatattggccaggccggttttgaactcctgacctcaagtgatccacccgccttggcctcccaaagtgctgtgattacaggtgtgagccaccgcgcccggccatttatatcattctttataccttacaagttttgtaaatattctcttgcatactcattgttggaaaaacataataaaaaagacttacttgatttttagaatgatgccacacacaaaacaaacccccaccaaaactggtatttttgacattccttctgtgcagaccaagtgtgtgatttttaaaacgcactggaaatgatgtggctttgaaaaggggcttaattagccctatgaactcacccatccagaatcccaggcaggtcatgtgattaatgataccttttcctgtgacctcctaagctctgacagtgcattgttctcctgcctgatgtcagataaactaagccactgttgggtggctgtgcatgttaatagcattgctcttttaagcgttcaagtttatttttattgttttcatcattgggtacttgcatgggttttagaaaactagattcaacaacactctgaaagacatagatggagcatagctttgttcccataacctagagaaaagaaatccagtgtggccaagtggatttgtccagcccatctctacctcttgagtgttgatgctgcctgtacttccaggtcttcagtgtgaaatattctctaatggttttatattcttagaaatatattctaagtcagtttggtcattacgataggtaatatttcagctatctattactgctgttacaaagcccccaaaattgagttgcttaaacagtaatttattattcattttcacagttctgtgacttgggcttactgggaggttctctctttggatcttttgtgcagttgctctgtgggttgacttgggttactcagggtcttccatgccattgcagtccagtgttgactggagctgcagttacctagagctcagatgagctgaaggttcaagatgggccattttcctacctggcagttgatgatggctattggctgggagctcagctgagtctgtcaaaccagagtgcctactatggcttctctgtatggcttaggcttctcacagtgactgggttccaacaagaaatggccccaagattgagcatcttttgggtcaggaagcggaagctgtcaggccagtgaaggactatgctctcaattggcacagccttacttgtctgctgtattttataggtcaaagcagtcgggccaacctagattcaatgggatggagagataaactcaaaagataagatcttgtgggatgggagatattattgtggccaactttggaaaattcagtgtgccaaagataatcacttccagaggtagatcatagctgagatcagttttgtttcagggacctagtttaatttcactttatcatgtgttgaaaacaaaacatattccatatgagggaaaaaattaggataaaggtgtctggatggcccaaaacaagtacctcccactttactccaaatcacaggcccgtggaaggctccctcccagacccaggctatccctttggtggctgaggacatttaatggatcctggccaagtgcccttcccataagcttctctgggagatgtgtggcttggttatcctctcccacagataagcatctacagcacactaggctcccacaagggcgacttaactgctgtttttgccaccacatcattctctagtaggcttttacattcttacctgaaattcttcctgaagagggtaattgaaaatgtcaagtgatgtcccctccttgcagccatatctatatactcactcagtcctgtatttttgagtcttatcagaggatcatttgaatttagaccaattttttcagcttttaaatttcgaaatcatttcaaccttgcaaaagaatcacaagactagaacacagaactctttcttccccaccttttatcctgtattaatgtgtagccacatttctgtcatccttcccatcccctatcaccctcactcagtcttgcacagtctctcacattcatcctccatagatgcacacacagacatacatacccagatttctcccagaaccgtttgagagtaacttgcagacatcatacccctttgcccctaagaacgaagacattattttccattgttatggaaatcagaaagtttaacttggtactgttacttaatttctaatgtatgtgcaacttttgccaggtgtcccagtaagattctgggtttttttgagacagactcttgctctgtggcccatgctggagtgccgtgctgtgatctcggcttactgcaacctccgcctcccaggttcaagtgattctcctgcctcagcctcccgagtagctgggattacaggggcacaccaccatacctggctaatttttgtgtttttattagagatggggtttcaccatgttggccaggctggtctcaaactcctgacctcaagtgatctgcctgcctcgccctctcctttgtactgggagtacaggcatgagccaccaggtctggcccaataagattttttatatcattttttttttcatggtccagggtccaacccagggtcccacattgcatttaattgtctcaccttcttagtcttctttcaactgaaacagttcctcagccattctttttcctgaccttgacattattttattttattttattttattttattttattttattttattttatttttcgagatggtgactccctctgtcactgaggctggagtgcagtggtgcaatctcggctcactgcaacctccgcctcccgggttcaagtgattctcctgcctcagcctcccgagtagctgggactacaggcacatgccaccacacccggctaattttttgtatttttagtagagacggggtttcaccatgttagccaggatggtctcgatctcctgacctcgtgatccacccgcctcagcctcccaaagtgctgggattacaggcgtgagccactgcacccggctgaccttgacatttttaaagaatataggctagtcgtcttgaggactgccttcagtttggataggcctgacgtttcctctgattgcattcaggttgtgttctttgggcaggaatctcgtggcagaggtgttgggtccttctcagtacctcttatcaggaggctatgatgtcagtttgtttaattactggtgatattaactttgattactggattaaggtggtgttcccaggtttctccggtataaaactgctgctctttcttatctaggaagtaacaaacttttctgaatgttggctgagctgtgctgatgaagccaagacccctcccatgcagtgagtgggccgtgttcactcactgtgcatggagtcaagtggttttggagaacatggaactagattccaagattggaggaaaaaagtcttttgggggttccactttgcagtcaactcacattcagaggcatgacaaccctctccagagagttattcttgccactgtgtttacagaggtgtttgttcgtattttctgccagtcatggaacctaaaaggttatatcatactgccttatgttcctagaaggtctagtttaccatcctaaacacaccttgtgaatcccctttgttatatttttattggaccttaaaaaattaaagtggaagagctaaaaaagtgagacaatgaacaaatgccttgagtgccagccctggtactcttgtctgtttgcatttctttgggaaaggttgtttaaactcttaggactttggttttcttctgtaaaatatggttaatagcaatttcctacgtacctcactggattactgtggcaatcaaatagacccttgttaaatagatgagaaggtacttcagaataaacctccatacaagcacagtgagttcccctaattaattcatatttcttaaatcagccaaaatacctatttccaggaaattgaaaaatagcttgccagactttctttggctttcagcaatgtgagcagggctggccagagagccgtgcagtctgacataccagccttgtggtttagtttcttccggatacctgtgcttagcacttttgcagggcagctgacagggtacaaagtccatgtaagcaagtggcaaagcaggatgagcaggaaacttgacagattgtagataacattgggaacttcttttttttaattctgtattttgttcactcactgtaaaaaaaaaaaaaatctatgacttgcccacacttttctaatttgaaggtcatgtttgtgtgtgcatacaagtgtgtgtgttttctaacttactctgtttattgggcaggggctggggtcggggactgtaaacagacttcttaatgagctttatcccaaagaatccacccttacttctcaggtagaagttatttttaaatgtgtgctcatgggtaattggtccagttttatttagaatggaacctcgcagtctgtggcgtgaactgaacctacatgtgaccattctcttaaaacaagcaaggctgttcagggctatgccaacttgaggctgtcagaacctcccccacctaggccaccctggccttttctccctaggattaggatcttgtcctgcatttccatttacttagatgggtctgacatagccaacaggctcctgccacactgactgagtgtgtgagccatttaagcagacacagaggttgtgctggaactcagatgctggctatggctgctgaggctgcagccagttcaggcctcccacccactccccccagtccagccctggagacccttgtggtcggagtcatgtctgcaggaaggcttcttgtctgcctacccattcatgggcagaagtgccagcacacttcagggacccccgaagcagagcccaactctttctatactgcttagagaagcccagagtgtgggctcgcaggccagttccagggagagaacaagaacaggcagggttgtgcacacccagcagctttgctcattctcaccaatcagagaaatcgtacctcattccacggggaggagggtgagggcaagcaagaagatcaggtgagatttgccaggccttccaatgccagaaagtcctcctcaacaggtcaaggtaggaatgcttatgggatgagaaagtgtttccatctgttatcatctaccacgagatagtctttcctacagcctctatcgccaagtttcaaatccactccctgcccttgtactgttgttggatcaaaggacacatatcattcacgtgacaatccagtggagagataatgtgctttgatcttggcaaggcactagaccaagtcttttgagacaccctcgtggtggttgggtggcgggtatacagctctactgtgggcgccactcaccttagataacagcgtgaaaggaagacgtggccaagcaaaagaccaccagctgtatctttatacatattaactgagactaaatgcaggctcagctaatgtgtacagttagtacacattgtgtaactcattggaaaaccatgctcaatggagcactgtcagtgtgagcaagcaggacatgggctcccctgttattacagttcatcttcctggttttggttcattcttgtctgtgaggattatttggatttttagtttatcatctaattgatcaacaccaatacctaacagctattgagtgcctactctatgccagttctataaagaacatcttggggtcttggtgaccccaaactcagacttagctgcgctggcaacacaggaagtagagcagagctgtaagaaggctctgtggcttagttcactgtgggaagccatttcacctctctaagcctagttttctcatctgtaaagaggccatgataatagtacctgtgtcataccatttacacacatatgtacacaaatatgtgtctgtagacatttagcagcctagtggctggtgtgtagacagcactcagtaaacatggacacaactgcagagagtgtgaatggaggtctgagctccaaatggccagggtaaggacctggtctgactgtgtcagaacacatgaggactcaacgtgctgaatcgtagaggcactcacacattacctctcaagccaaggctctcaggagcctcaaggtcaccatggggattggacactacccctccaagcagaacagctccactcttacctactgggtacagacagagtgtgtgtgcatctgtctctgtctctgtctgtctctgtctctctctctctctctctctctctctctctctccccccgccttctctctccctctctccctctctttctctctccctctctccctctctttctctctccctctctccctccccgccctaccccatgtctcagggattctcagttgagggagatcttgtccctaaggggacgtttagcaatgtctgaaggcatttttggttgtcataacctgcgtggggagcggactgctgctggcatctagtgaatggaggccagggatgctgctaaacatcccacagtgcccaggacaaccccacaacaaagcactatccagccccaaatgtcagtgatgccaggttgaggaagcctgctctgcgggcgtatatgtatggcggggcagggggattctctgcatggcttttatttggtaaaagtctaggaaaaaatagaagatcagcgttatatagtgtacctggaaaaaaccacctgattgctaagcactctgaaaaaccacatcccttaggagaacccgagtgtggggcctgagcccaaggccagaggggagaatagtctgcagagagtcgaagcaccatccacaaagacaaggtgtcttgggagttctgagttgctccaggcctaatggcatgaggacacagggaagccacttggccaatatgaaagtccacatgccacttgaggattcttttctccttcaagaccaagtttaatattgatctgatcatatttccccttattagcaggatctgatttggtaactctaagcctctggtgaaaaatcgtctttgaatatcagggtgatttgccatttttattgctgtttttatagatcaaaaaagtcagatattagcaattcatggttcaacctgctgaggattgagggtgatgacttgtaatttctgtatacattactttatatccttcctagaggaactctgtacaaatgcccacatccctgttcaaacctctagggaaactgggcatctcaagctaagctgttacccctgtcctgaacaagcagcactcaccaggagcccagcctaggctggcgtacctgtaacggaccctttcccagcagacataagacgagctcctgtgttttaaccaagtggcttgtcctcaccttttgcatctgcccagttgggagaagagagattcttttaaacctgagaccctccaaaaaacaccccccatccccatctcttggctgtgttccttggcatttaaaaagaaatggggaaccttgaagacttgctaagtaaaataagccagacataaaaggacaaatactgtgtcattccatttatacgagtcacctggaagaggcacattcacagagacaggaagtagaagggtgattgccaggggctgaggggaggggaatggagagttgaacgccactgaactgtacacttaaaaatggttaaaatggtaaatttggtgttatatatgttttgtcacaatttttttaaaaggagccagcatgttcattgccatatgctgaaaccagattcaaccctgatgttcacctaaaaagagggagtagggaagtgcctaatactccatctttacattgtcatgaaacctaagtgagattaggacatggcatcatcagctgggcttcttaaaatgtttccctttccaccagggccgtcttagagagaccgtatattcctgttgggctgagagcactttagtgacttttgagtgtgtgctaagccctattttccttcctctggaaggatgaaattgttcagcttgttggaactaggtgtcttaggaacagagagctctgtgttcaggcccagtaatcatcctctggcatattttttgttttccaggacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcaggtagatgctgccaccgtgccttggctttcccaagacggttctcctcagacccaatccacgtgccattctctcatgttttggggagggaaagggatttttctctggggacaagtgcatcccctcgtgcagctttcttgggtttgcacgttgctcctgagttctttccttcagtcttctgagggtcccctggaggaaatctagaggctgactccactcatggctgtggaagctcacggggatgctgagtaaaacaggcctgcatctgcacctcacgcaaaagaagatcttcctttagactttcaggcttctatgatgcagtgagttcacccagatggtggctgctgtggcacttgctagtgaccttgtctttcctcctcatgtttctattgtcttccactgtaaaatgcgtccagggttccagccagcccatgacagcttctcttgcttggtggtcgattgtgctagtctggacggcatttcccatcaccacactgggttggattttttttcacttccaactggcagctgctgtgtgagtggaatcattatattcgtttcccttgatcttttcctcttgatgcctctcctctggtgcagccttggggaagcccacagcaggcaccactgatgcaggagaggctgcgaagatcttggctgaaaagagaagacaggcccggctgcagaaggaacaggaggagcaagaacgactggagaaggaagaacaagataggtatgctagtgctcagaatttcggtgtgatctcatgtaactgttgtgttggaaagagcagcttgcctttctttttacagcgttggtattgataaaacttgaacagaagtatgggaacctagaatgtctgaactacatggaaggtgttcaggagactgagtcttatattagatgtaattattaataacaatggaactttgttcttttcggaggacctggaaactcatagctcttggatctaaatggcacaggcatcttcccattctcctcttggactttggggccaggcaggcctcctagagctatcagggaagtctgaactttgtttaaaaaatgagattctccctgggaaaacaagaggttcaagattctggttttggtcttgattctgatttccaaattgtttcctccgtcaaattatcctaactcacaccccaaagtgagagacagaggggagggttgagcagtgtcccctaggcatagggttgtgtgtaggggcaaccgcatagtctaagaacagtgaggtatggggagtcccatctgggagcaagacaaaagacatcattgcagtggtccctacaccttgaagagcatcagaatcatccggggaatgcagtaaaaacacatggactcagccctgttctgttttagtagcttgccagggtttgagaaccactgtgatgttagtaccagggtactttgtcacaatacagacagaccttccttttctgatctttttatttagagaggaaagcatgttgaaggacaaggtcgattttatcattaaattgataaaggaagccgttaggctcatcacagagtacaatccaatactgtttagagaattatcatgacaggaagcaggcaatgctgtagcacttcaaggccagcaccgaatttagagtaataaataatagaatattattgatcctttagtgaccttggtaagtctttgtggtctctgattacaggtttgctgatctattttttaaaagggacagtggggtaggtctcgacagtcccttcttgaaatttgggacttctttgattgttttcctgtttccaacattttggtcaatacagacgtgttttgtttgtttgtttgtttgttttgtcgagtggcatgtttgggctggtttgggtgggccttaaggtgtgtgaagggaggtcacaagagataaagatgaatcacaggacctcagatgacaggccttgataattgcaggccatggagataccatgtaggctctgagctggtgagtaacatgatcgtagtcgtgtgctaaagaaggtgatgttctttactttccagctaccaccgtctgtatctcccattttcttcacagcccagctcctgaaagacttgattgaacattctgtctttattttctcaactcacattcagtcttcaaacctcacacctaccactcctcctcgttgcctaactactaatcagtttcttggttggctttggccttgtcaagcttgcccttgcttctctggcctctccttcatagcctcctctgtctgcccctcatccccttaaatgttgcctgggctttcagcccttagtcctggaccagcttctctcccaacaagctctcccgaacagcactgctcccgcctgttctgccagtgtccctgccatcctgccagtttcctatggcgtcaaaagatttagggcccacattttacacaacagctttctgttgagcctttgttgtgctaaaccagctctgctctcatctcacttcccaccttcattttccctttgtcttgttttattgtccgtttctgaagctaactgcagcttgctttctaaaccttccatactttctggaacaagggaggcactaataacacatgtgtactgatgactcctaaaactatgcctgtggcccaagctctgtctagggctgcattgtccactatcagaccctctaggcacatgtggccaccaaaatatacattcagtaaaattcatttccccagccacacccgccacatttccgtgctcaagagctgcatctgagtagatgtggatccacaccacattgggcagcacaaatctatagattgttttcctactcaacagaaggttctattggatagcactggtctagaacctagagactgtatttccagctgcaataagttttcgtttgagtgtgtcccatatacatctcaaatccagcatttccaaagcagaacttagtattttttccccaaacttcccttctctttcatgagctctgtgttcccatctcctcagacacccaagtgaaaagtctcagtgctactctcagctctttcctttccttcttcttcccaatggttgtcaggtccagtcttcatcagctgtcacattggcatctctgttctctcccttcccttcccgtccctcctctccttcctcagctccagcccccatcgcttctcacctggactgtatctgttatatcccaactgagctccctgctctaggtctcctagagtttgtcccctgtccacgctgggcccacactgacctttctcaaataaatgtgattgttctcctgtcctttaacaagccagtgactcccctgcccactggatccacccgaacctgtcaacaggccttcaaggcctgccgtgaactgaccactacctgcctcttactccttgctttcctccagacaccagtgtgcaaagctccctgacattcacccatcacacggctccacacctccaaagctgtgcttttactttgcccccacgtggacttgtgctccttcctgccagacacctcttcatttctcaaaatgcaggtcaagtcttgctccctccctgtaccttttctggccctgtgcctgggacagaactgaccaccccccactcttcacccatactgagcccagctgttcagttgactaacatagcttcatttgtttacaggcctcctttccccagttagcaccttaaaaggctgggacatagtctttggatcactggtgcctggcgctcagtaaatgtacaagaaaggaacagaaggaggaagaatcctgactaagaaaccatcgtagtagtaggttaagagaacagaagggctaaagtagtatggtgaaggcagacatgcaaaagccagtctctgtggacttacacaatgccaaagaaatgggcagatttgaagttgatgctgaggtttgattctaaggtcttaggagaatggtacacccaataacaggtaaagaaaggacataaggaattggttttaaaagataaaaattattcatttgattttaggtgaggttatggtgtctacagtacgtccagatgattggagatggaattgaaggttgggggtgtaggtaaaaattagagcaatacactcgaccccaaatgagttttcctctctcttgccagaatgtgaagctttgcatagtgccacgtgggaggtgaggagtgaggaaggaaagtaccagacaacctggggctggaacacagcggccacctcttggaataagatcatcctcacatctgttttatgtttacagttaatagttaaagccacagaaatgttgccagataaaataatttagagaaaaataaagttacttgagtcaaaccgtggaaagcccaattattgtcacaaactggtaagggaaacaccatccaagtcaaggatgggggaaccagaacagaagggccaaccaggagtccagacaagcaggccctaagcagaagaacaaaagttggtccattcccaaacacaacagggcccagcccccaggctgtggatggcccaagatataaagtgagattcttagaggtggggcaggaaaccttagacgccgggtccaccctggggaaggcactggcaggaactagtaagcaggagatcttaatgggattcctagacggatcactttaagtcatgttaaaaagctaaaatagctactaggggttcacatgaaagaatattccagccagacgcaatggcttgtacctgtagtcccagctacttgaaaggctgaggtgggaggatcactagaggccaggagttcgagttgagcctgggcaacgtagagagaccccatctttttaaaaaattgaaggaaagagaatattccagttagacagctccctacgagcaaggtcacgtaggcaggctaaagtttcttgtcgaagcaagagttagcccaggccaggaaccacaggcagaggtcttcgaggctgctcagacctggctttttgctgctgagcctacaggtggcaggtggttttggtgagagctagggcaggtgggggcacatgcgatgtggggcagcaggatgtagcagcagctgaggcaggaagggaaagccaagagaggtaggagagagccagggtcatgcagccttatgtagcacagggctgtagggagagccacatgggcaggacttttgataagacataggcttatcaaagacgaaggctgttggtcttgggatttaggagatgaaaagagattttggagggaaattgttgagaagtaggatagagacaaagcagcctgaagagatgagtggatacaggcccagaatataagctggctgttaagcagtcatgaatgagaagcagctgagagaggactgaggagggttgcttgtgattcccgagacatgagcatttttccagggcatggaaaacatgcatgcagaaggttgaaactgacaaatgaagggaagaggggctagtgggagggacacatagctgtggaggatgtggaattcacagcacaagtggtggcatttccatctaagcagaggaacaaatggggacatttctgagcagtaatgtcatagaggagagtttaagaagctcagatcaggtggcctcagtcttctctgtatagcagttggtgataagcatcaactaaggaagatgacgaagattgagaaaagtggtaattgggactgtgtccataagggatccaggggatgaggattaaaaggccggaatgcaattgccagcaggcagataaccagccagcctcgtttacacctctctctaaccagtgattggcagcccaggagtggtcctggaaaccacccaagcctggagttgggcagcagagtgacctccatgccatctctgaaatgctcacaagggtacctaaggcctggggaacactgagagagagggaagcagacgcaagtagactgcacagcgctaaccagggcaggtcaggagagaaaaaggcagaaggatggggtgtgatcagatcaaagaagattaatgttgaaggttaggcttgttttaaaatgaaaacttttaagcacgtaagaatagagaccagtgaaacccacatactcgtccctcagattgaacaattcaagtttaagtttgtgtcagtgacatgaggaaggttaacagggagcgacagaaaagggggcgaggtgctggagtttccaacagacaggagccaatatatgaagatcctcctcaaatggccagtgacagggacaagggatgatgcatccactgaatgccaaatgatgacagtaatgcacagttttctggtactttgtacatagtgaggaaagggagagggacttgggtgaatgacaagaacaaggatggagagggtgacaggactacacacagggccaggcactggctcacacctgtaatcccagtgctttgggagaatggggtgggcggatcacttgagcccaggagtttgagaccagcctgggcaacaaaatgagacctgtctctattaaaaaaaaattcaaaaatgatccaggcatggtggcactcacccgtggtcctggctacttgggagctgaggtgggaggatcgcttgagcctgagaggttggggctgcagtaagctgtgatggcagcactgcactccaacttgggcaacagcacgaaaccctgcctctacaaagaaaaaaaaaaaaggactacacacagagctgatgaactttggaggtttagtaatgacggcaagggcggtaggctcggggtagcccacggcagagggcggtggggaaaatgatgaaatctaatgtgctgtctggttctttgagcagagacagaaggaatgctcatcctcggagaggattgtgagggacctggtttcacacaggggaagccagggttgtttgttttgttgaattttacctactttagggaagcaaagtgtggttaagggagagaacttggtatataagaggatgaaggggctgggcacagtggctcaaacctgtaatcccagcactttgggaggccaaggcaggcagatcacttgaggtcaggagttcgagaccagcctggccaacatggtgaaaccccatctctactaaaactacaaaaattagctgggcatagcggcgcatgcctgtagtcccggctacttgggaggctgaggcacaagaatcacttgaacccaggaggcagaggttgtagtgagccaagatcacaccactgtactccagcctgggcaacagagtgagactccatctcaaaaaaaaaaaaaaaaaaaaggacaagatttccctggaggtgctatggaaaggacaagcggggtctcatgggcttgtggggatttatattttgggtgataatgaggattatggaggttcaggggccataaggatgttcttacatgtgtgcatctgggcacttctgaagtcctgatggtaaaaaacaagaaacagaggccaagtgcagcggctcatgcctataatcctagcactttgggaggccgaggcaggcagatcacctgaggtcaggagtttgagaccagcctgaccaacatggtgaaaccccgtctctactaaaaatacaaaattagccagacatggtggcgcatacctgtaatcccagctagttgggaggctgaggcaggagaatcacttgcacctgggaggcagaggttgtggtgagccaaggttgcaccattgcactccaacctgggcaacaacagtgaaacgccatcaaaaaaaaaaaaaaaaaaaagagaatggattttcaggtcctggagatgaagacggcaggtcctttatgaagtagcttatacattaattaatacacaatgtatcctttgtgtgttaacttctctgggacaatcataattggctcgttaataaagggtaagaaatgaaatggtacttcagttaacctttagatacatcttgttattaacacatccattttggataatcctgtgttggacatagtatttcattgaggaatctaagaaaatgggagcttctttctgataggttctataatgctcctctccagaatatctgttaataatttgagttgtttcacaatggtttataggcattgtgacctaatttagtgttatcacgtattgttacagtctcaggctaatatatttaagtatttgtttatctttcttttaaaatatttctttgaatgaataaacaaaatatttcctttggtcatacataggctgttagcctgcacaagttctgaagctgaccattaggatggatggatgctctttttaagtcttgacctttttataacaacagcatcccagtaagtcattggcacatgcttccaaatgaaggtaatttctaaaggacatacagatttataggtgcactttaaaggacattggggcttggagagaggattcattttaaattgtaaaacaaactaacgtttgagaaccttctagggccaggcattttcattctcacagtaaagccatagaacaatagtatagcttttcccattttttaaatgggcatcaagaacattgagtgactttccaggtgtcacacagtgagtggcataatcagagtacaatttgagtcatgcccatacatcacattgccagtgattacccaaggaaagtgacgtacatgtgaggaggaggaacattagaaaggttaaaacaagctcttggactttacaggattttcccttactgcttcgagctctttaccattacaccatgaaccattcatctgactgtggatgaaaatgtctaaatgccacttaattttcatatagcaaagaaagctaaaatagatttctaaagattgccaaaataaatggaaatagaggttttaatttattaaatgtcaagtttctgttgagcattttcttccatttgctgcttcataagtcacataccaattagaaccaaattggtatgactttttgagttcgtagtcactgctcttaaattgctgactggcacatttgtggccattgagacacttcccatttttcctagctttcattggttttaaatattctgcttaggttttaaaagaattgtcattcaataagaatgatggcttggctttctgtcaccgtggtcatttgttcattgactgaggagcatctgttttcaatacagtatgcgttacacatcaacacatcattcattgctgtattacagaatttaaagtcaagcctggttaatactttttggtaaatatatggaccagagtggatttccaggaaggatgaatcatgttattaaatgaatgctcgttgaaaggtatgtgtgtgtgttaccatgtggagcattattctcggctgtcagcacacagttctctggcagtttgcttttcgagcatgtcatcttctaacaacagttgtattctcaaaaggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcaggtactgtatgagtcctcagatggactttacttgttttttaaggaccttgatagtaggtacaattagttaaatttcaatgactcataatgtttacttgaagtttcttcttaaactgtctgggctggttattaaatataagttggggcagttgcagtgaagttggtaatgtttgccatctgtgagttagggtttccccaaaggcaaaccctgggctaagaatttgagtgccagcagttttttttgcaagcgaatcccaggaagctggtagaggaataggagaaaagccaatgtaagtgcattgatgcatgtgttactgtgggtgactggaacacagtcccattgggaacctctgacagactgtggatcatgctttagaattgtccagctgagggatgaggaaactgaactacttatctaccacatcctgcccttcacggtagtagaaggtcactccctggggaattaactctctgatctggccacatgcacacttcatggcccaagcctgcccacagacacagaaaagccttggccatgtgtgagaactgtctgcaggtgatttgcatggtgagccaggggtatatgaatgaggtccaaccatgtttgctgtgtcatgcagtggtttgtataaatccacattgaatattggagcagcatccactttagggcagatgatgagatgaaggaacatgtgcaaagccagggaattaccacactgttttcttagcttattaaagctttgccttgatttacctgtttctgttagaaagaagcagcagaaacaaaggcccgggaggtagctgaacagatgcgtctcgagagagaacagattatgctgcagattgagcaggagagactggagagaaagaaggtaagggctgagggtcaggaagacctagggtaagtgaacaggaagtaaatccagttctcttctgcagtgattggatagaatgatcctaggattgtcagttaggtcaagttcattgataccactgttcaaatcttttatgtctttattagttttttgccatctcgttccatcagtgattgagaaagattgttaaaaactccatctgtagcgaggcatggtggctcacacctgtaatcccagcatttagggaggcagaggcgggaggatcacttgagcccagaagttccagaccagcttgagtaatacagtgaaaccctgtctctactaaaaatacaaaaaatagctgggtgtgatggcatgtgtctgtagtcccagctacgtaggaggttgaggtgggaagatgacctgaactcgggaagttaagcctgcagtgagccgagatcatgccactgcagtccagcctggggaacaggagtgagaccctgtcccaaataatagaaaaaagaataactccatctgtgattatggatttgtccatttttcctttcagttctgtcaggttttgttttatatatatttatcgtgatatgcctttgtctctagtgatatttcttgtcttaaagtctactttgacagccccctgccttttatttttttgagacagtctcactctattgcccatgctggagtgcagtggtgtgatctcggctcaccacaacctccacctcccaggttcaagcgattctcctgcctcagcctcccaactagctgggattacaggcgcacaccaccacacctggctaatttttgtatttttagtagagatgggatttcaccatgttggccaggctggtctcgaactcctggactcaagggatcctcctgcctcggccttccaaagtgctgggattatagacgtgagccactgtgcttggcctgacagcccttttatgattagtgtctgtatgtcaaatctttttcacccttctacttaaaacttcttctgtgtgtttttataagtaaagagcatatagccaggaattgttattttaattctgtttgacagtctttgtcttttaattggagtgtttagtccatttacactaactatacttatgggtaaaattgggtttaagcagactgattataaaggagtattctcatggtgtcctaggcccaacctgggctttgtattgctgtaggcctgggatccaggagaccagcctgtggccttctctcctgagatgcacctcagcctcagcctcactttctgtagggtggtgctctttaatggcaggtggtaatttgttgatttatacagagcctaaggagaagaaggagaaatatgggatataaatcgaatattgattctagatacgtactagttaacttctcaagcatttgaccttgtccatggggccggaggtgtacatctccaaaactagtggaaaacctttctatacttgttatcctcttctgacttttgccttttacaagttttctgagaaatgtgacattgcatgtaaaccaagctacttttatgtttttggtcttattgtcctcttacttgattttgttttttgttttttgtttttagagaatagatgaaatcatgaagagaacaaggaaaagtgatgtgtctccacaagtgaaggtaggaattcaaatgaccattttaatagtttatgtactaagtagaaaagaacagcagaatacactcagtgaaattgtaggtcttggcgacgattagccagaaaaaaatgcagttttcctgctttgttcctggctaggttaaggagggttaggtacctgaaaagaaagaggggcttcagaggtgggatgggtaagagatttccttagagtcatgggaggtgggatgaagagagaggcatagtagtccatgaataaaaaagagaatcctgacataaaaatacgtaagaataagggaaacacagctgaagatttaaagaattaccacagaacaggcagatggtccaggctcaaaatatcatcggatgcttttaaaaagtactttttttctgtgtgatgtcagccttccctcatttcattcaccttccatttgttttcagaaagaagaccccaaagtgggggtccagcctgctgtgtgtgtggaaaagaagacaaaactggttgtccccaacaaaatgggtgagtgtgacatctggttcttgggttcttccttttagtagcaaaagctcgtaagacttggtgtagggtaaacagacccatggatcccaagagggtgactgctggcaggggcctgtgcagtttcccttccctgggaatgtgtctccagcacagggactgtcagctccacttgggaacccactgggttccttggttactcccataatcccagcataggaggcactctggctgctggctcacagtgctttccagggagcttaactgctggtcaggttttattactgttaggacctgactctgctcttctccagaggttctgcacagacactgataatgtgatttgtcttctcttctcctgtgtgaaggtgattatatgggtttatttgtggctctttccacaaaagatgctgcagtatcagtgaagcagagcattaaattaattgccttgatctatatttctctgttactttatttagacattttatgattaacacaagggactttgtgttctcgatcagaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgaggtatattcatttcttttgcatttaagcctcatcacttctcgaaacactaccctttcttttagttggtttcttcgtcttttatacaaccaaatcacctaaagcaggtttgattgacattacaggaaagctctcagtggtataacattctagtgtcttgcgtcaggttccctagaagcagagcctggaacagagtttctagggcatgtgatttgttagaggaaagctcttgggagtttttcaggagaaaggggaaggagggaattcgctaagcaaggatgccttctcagctgaccccatgggagctctggaggatgaatttccaccagagacagttcctctgagcttctgcagttctggtttttctagattcttctctaagatctcacaaggaagaaaaagaagaacctggcagcagctttactctggctgttaagagattcctggtgacaggccctcagcccaccactcttcagagcctggatttgttcctttgctaggccttacagctggcgcaattatgaaactcctccttccatctctagggagaggaagagagagagagaaagaaaaccagccttggctgggctggagctggataagtcagagtggattggaagcctcactttagagaggaagcagagcgtgagattggctttgccagtgatgacgtgggctgtggtgggatcctttcattatgggccccccaaccttaactgagcacttcaggcgtttccacatgaactcttctcagcacgatcagattcacactcacaggagccctggcagagagaaacaattgttcccattttactggcgaagaaactgaggctgcaggaaggaaaagcaattcgcccaaggtggcactactagaaaggcagcactgggagccccactgttaattagggttcttcttcaacttgctttgaacttttggcattggctttctgtctgaatgtcccatttagaaagttctggaatgccttgcttctttgtggtagaatgctggtgcctgtgggtttttgtcctttcaccctttgggcaatgtgaccttggccatcacagccctgctcaatctgcttccctgttctcatacatggggcctcgtgtccaccatctgtcctcctcagatttgagcccacttgtattttttacagtgtgttacacaaaaactctgactctaaatccttcttctttagaagagtagtaaaacaaaatattgcaaatagaattaatatattgtgccatgttgtctgtctgtctctttctgcctctctccctctcgttcatctcttctagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtacagtcttttgattatattctaacttcataaccctttaactggggtttgtgaagataggatgtatatcactcagcctcttggatggtcaaattttatttgaaaaacgcaaacatgaatatattatggtatactacaacacacacaagaattgagacagatttcaattaattcatctgcgagccttcagcgccgagccgccttgtcctaaccctgctatttagggtgtgtagatgggaaagttgagaacactggctaaaggtttgactaccagtccagcctgagtagcttttttagggggcaaggaaagaatactctagtagtgttgcaaggtgatatgaataagatgaatttccccacctctagttttgctcagtgacatcccacattctatctagaatcattcatatacagggccacaggatttgctattctcttgacccattctggattcttccaaagcagacagctattcttggatcatacctgagggagagagaactgcagtttttgtgtcttgaaggttttttccccacctttggcctttttttatttttgccaaagtgcttccagaagctattctcatttgagcaagaatgtctatgagttatatacactctgtagtaaggtatacttagttacatatacctcacattttatttacttcagtttggggcttgtttttgaataaggaaaacataattagagtctgtcaccaaatcctttaataatttaataattccaattgctcctcccacttcagattctgtttttgttttcaagagaagtgatctcactctgttgtccaggctggtgtgcagtggcgcaatcacagctcactgagacttcaaactcctgggctcaggagatccccttgcctcagcctcctgagtagttggatcataggcacatgccaccaggcccagctaattttttttagtttttgtagaggttgggtcttgctatgttgcccggctggtcttgaacccctggcctcaagtgatcctctctccttggcctcccaagtacttactgggattacagccatgagctaccatgccttgcatccatttatccattttagattctttttttttttttttttttttttttgagatggaatctcactctgtcacccaggctggagtgcagtggcatgatctccactcacagccacttctacctcccaggttcaagccattctcctgcctcagcctcccgagtagctgggactacaggtgcacgccgccatgcctggctaattttttgtattttagtagagacagggtttcactgtgttgcccaagctggtctcgaactcctgagctcaggtaatctgcctgccttggcttcccaaagtgctaggattacaggcgtgagccaccgcgcccggccattttagattcttaaaagcatttttatattctcggcattttctcagtcactttattttttatacttcactcccataacaaattcactggccaaaataacagtccagtgtttttatttttcaaatgaggaaacaggtgggagaggctacagagctgaggtcactgtgttttttgtatacttgtttctacctgacctcagctcttgcctataagacaagtttgagagcccatttctcttggttcttggtgtgtggtgggtcacttttagagtaaactgtatcactggtttggaaaagcagctgccttcttggacacttaaaacactaaatcacctgagcattctatttccctgacagttacgtggcttaatatttattaagaggttttttgtgtttttaacatactttgactttaaaattagtttcccttcagttcacttacctcactatacagtaaggaacagagaatccacaaaatttattagagtattcataggtcctcaaatttatttcttacatctctaaaagaaatgcaaaacccctgtccaaaaagaaaaatctcaaattattttattcacactgcttgtatatttttaattatgattgggtctagttctcaaattcttctctaccaaaagtggtaccacccccaccaggagacgtttggacatacgttgatggtttttgttgccagagtggctgggggcatttgaaagacaaagcttgagacattaaatatctgcaggttttagaaaagttccatacaaggaaaatttgacccatctaaaagaatagtcctatgtaaaatactctatcacttctgttgagaaatactgtataagcccaggaggaaaatataattgccaagaaggtagaaagtgccacagtgtgttgtgatcgttttagtgagagaatagtgctacaaactgcacaatacttggttttccctttgatctcatctggttttgtttctgaattgacacaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgatatgtaccttgtgtttaatgtgaaatacattttcattgaagagtctgatgacttgctagcgttttattttttctgtaagctcaatgtgctgaaaccaaaccaggcttttaaaaacctgtgtagaagaaaaccaaaaaatcctgtgtgggtgtcctttccctgtcaaactcattaaaaattcctttgttgccagtgcca

SEQ ID NO: 3286 - DNA, 109923 bp, human
agagctgagataaacgccctttccctggcccaggatcgtccggacgtgcatccaagggccgcacccctctctgtgcgagtggcggggttctttcttggggcgacctgggtgagtgggtacacatggggggtggcttagggtgggcggcaggtgtgtttgggatggaggtgcctgagggggtgctgcgggtccagtccccgtcctcgaggagcagccggcatgggggtcgttaggataaaccgagcggggttctggggttgccccggcctccgcgcgcgctctctctgcgttctgggaaacgcgcgcgagcgccgctgcagcccgcggcgaaggtggcccagcttcgcgcctcttggcgtttccagggggcaaaatcggcgtgtcacccattggcagaggcagattcgcccgggcggccaggcgtctgccccggaccgggtgctcctcccgcccggatgcgctccctgtcttgggaacgctgctcaggtggccgggccgcggccctcaatcgaggcagcggggcaaacaaggctctcagccctcgaggctgccgatgctgggagccatggagggctggtccctggctgcccagaagccagcgaggcagcggaggagactgtgaggacatttggcaggattttagataagcaggtctgatgctaacgttctgtaaagtggttgcaggtagtgcgggggtgtaagcagcatggaaaccgatttcatgctgtttttcctgacaacaacttttttatttttagttaataaggcaggctatttttaaaacattttttattgcagtctaatatgcatttaaaaaaccacacaaaactataattcgatgaattatcacatagtgaagatgggagtattttatatacgatgggccaagaaaaggaaagaaatcaagagaaatcttcttaaaacacgctttttcactggggttgagggggcgaggtagtattttctgactgggccttcagttgcatcattcttaggaggaggagatagcttaaatcatttccagtttgtatttttcattatgctattttaaaggcagaattcattaactgtcacaggataacgttataactacctttgaaatgtgtgcttttgtttttatcctttttgcttgaaacactcaagctgcatctgctagggaagaacctggaaactacccaccagaacgaccctccgtggcagaggcgaccttgtataataaaacactgaaaaggagaggttgtttcagtttgcatttttatttggttgagagcttaaataatagtttgtttcgatgttctgttgtactcatgagaggtggggaggggcggtatgattgggttttcagtgtatcttggattttatttgaaggaacttaaggggtttttttttttttttttttaatggaaacaaaattggggaaggggaggaggtacttttgcgggggagattcttaataagttctgtttggaaactattgtagaatcatttaatgcactcttctgatattaagattagcttaaggatatcttccttcatttgaaattggaaatatagaaaaatatgtgtgaaggtttaaaatgtgaaataagcacctatgtgcattaaggttggtatggtaaaattggaatgtttaatttaggtgccaggtgataccaccatttgttgtttgggggagttagcaaggccaggtacttaagtaaagtctccttagaaaaattatgattttgaggttttataattatctgtcctggatactgatcattcttggttacccaggcccttagcatttgggacccattcctaatgagacttaacctgcttttctagagagtcaaccattgttcctaagcttgggctgggtgctgtcaaggctgcaaaatacagaaagacctgagatgtttaggctgtccaacaattttgtgttgcacacttaggggatatgagttggcaagtggttttcctgggagctgtgtaaaagacggaaaggaaataccgctggtggtttcctctagcaacaggttcttccgatattgaaatcctgtgcatgttcccattaccccctagtgatgccttctttctttccttttaattacctctgaatagaaattaccagatctactgtccattttagtgcttgtctgatacacatagtataacaaatgagcaagtgcttgtttcaatctgcttaacaacctttaaccagcagatagaatcaccagatctcaaccatatttcctttctttctttttagatgaagtctcactctgttgtccatgctggagtgcagtggcacaatcttagctcactgcaacttctgcgccaccatgcccaggatcccagcactttgggaggccgaggcaggtggatcacttgaggtcaggagtttgagaccagtctggctaacatggtgaaaccctatctctactaaaaatacgaacattagccgggcctggtggcgcatgcttgtaatcgtagctacttgggaggctgaggcataggatcgcttgaacccaggaagcggaggttgcagtgagctgacctcgcgccactgtactccagcctgggtgacagagcgagactccgtctcgaaagaaaaacaaaatagggtggggcctggagatagagagtaggtggttattggagactgcgaagggtactggggggtgggaaggaggtaggaatggttaatgggtataaaaaaatagaatgaattaataaggcctggtatttgatagcacaacagggtaattatagtcaataataatttaattgttcatttaaaaataactactagtatgactggattgtttgtaacacaaaggataaatgcttgagggggatggctaacctgttttgcatgatatgattatttcatattgcatgcctgtaccaaaacatctcatgtaccccagaaatatatgcacctactacctactatgtagccacaaaaattaaaaattgtaaaataaaaaaaaaagtagagtgggcccgagtagcaaaggcattgggtccccaagaaatcggagttcttcatcctttttcaaagttgtgtttaaaaccattcttgaacgctttaatcctaaaactgttcagatcgctgggcgtggtggctcacgcctgtaatcccagcactttgggaggccgaggcgggcggatcacgaggtcaggagttcaagaccaggccggccaagatggtgaaaccctgtctctactaaaaatacaaaaattagccaggtatggtggcaggcacctgtaatcccagctactcgggaggctgaggcagggaattgcttgaacccgggaggcggaggttgcagtgagcagagattgagccactgcactccaccccgggcgacagagtgagactccgatcttaaaaaaaaaagtgttcagatcaagaagaacaagagaacaagttgagtttgtgcctctagagtctctttggtagtaggaaggaccacaaacttcctacaaagttgtatttggtttgtggctcctggctttttttactgatggcagcataggacttagacttagcaggaccttcaggacaaactgctgaaagtctttgtgatttctcttctcatatcctagccatggtgacatagctgctcaaagtctgtcatttctaacctgcttcctctccaacatgaaaggatgttttcctctcaggtgccccatcttctgcagtggctagtgttttaaaagaacactttgtcttcttgtaattacattgattgccttacaaaacagaaggattcacaaggttgatttgggcaggcgagagatggagatttctgggggctgttggtaaatatcctggtgggtcttgttgagaggatttgatgagatatattggctggtgatacaatgatactgcctggttttagggggctgttcatgtgctaagttggctcaggcggcagttccaagatttgaaaacttcccatggccctgccctccggtcccttttgaaaggaatttcaccagaagaaggaagagggggtagtagagggcagccgcccttagggagggagtgtccactgtccacctcacatctgagtcggccgcatttaaatatggagtttaccgtcttggcatctgaggctctgggtctgactaggccttgggatcccgcctcgtctgcctctgaggtcagtctgaatgcaagcccccatctgcttttctgttgggaagcatttgttttcctcttgcctaggaactttttctgtttttaaaagccttgtgactagcagagtttgggttgtcatttaagcgaaaggaaaacaggtatgagtgagccgcatgcatgcaaagcatttgaggcaacagcagtgatgccaaatgcctgagatccttggaatgacagggtctgtccccagggctcctagcttctgaccagtgctgggttcgttcaccacctaaaaagacttggcttttcctctcagtgccaaataggttggtgccttgtagcccccaggcaaccctttggaatgttccttgctcctttgtcatctcacccgcttcatccgtcccaccctctgtgtttctgtaataacagctttatggctggtcgtggtggttcacacctgtaatcctagcacttcaggaggctgaggcccacagatcgcttgcactcaggagttcaagaccagcctgggcaacatggcaaaaccctgtctccacaaaaaatacgaaaaattagctgggcgtgatggcacgtacctgtagtcccagctactttaggggctgaggcgggaagattgcttaagcccatgaggtcgaggctgcagtgaactgagattgtgccactgcactccagcctgggtgacaaagtgagagcctgactcaaaaataaaaataaacagctttatcatctgtataaaattcatatgccatatagtccacccatttaaaatgcacaattcgatggtttttagtatattcacagagttgtgcagccatcaccacaatcaattttagaacatgttcaccaccccacaaagaatccccatactcactgacattcttcattcccccggcctcacaactacccatctgtctatatagagaccacgagacttctgccgggacagtcttcagcctttggtgcagacacgcgttgcaattgcctagaagtctgtgggtgggtcttcatgcattagaggtttagaaaccaatattctgcatactctgtccttcaggtctaagacgcgcttttaccctgaagccttgccttttcacctcctgtacattcccactccacagggcctgcaaagcgctcagaacctgaatgtaatgtacacagcggtctgcagttatatactgcacatgttcattttagcttcccagacagtaatggccgctaattgttgagcacttatgtgccaaccctcatagttctgggggttgcctgggcttattggagaagttctgctgctccatttggggtcacctggagtccctcatgctggtacagtctgctggtctgctgggagctcagttgggctcgaaatgtccaagatggtctctcattgtccaggtacctaatcacagagagtctgtcctggactttctaacagcgtggctgctgtgctttgaataaggaagcagaagttgccagttctcttaaggcctgcacatagaagtcccagaatgtcatttttgctgtgttcagtggtcaaagcaagtcccaaggccagcctagattcaaggggagaggaaatagactccacctgttgatgtgagggcagcatgcacctactgggaaatgagaaattgttagtggcccttttggagaatatctactgtaataggcaagtacagtcgttccttggtatccatgggggatttgttccagcacctctcaagaacaccaaaaatcaaggatgcccaagtccctgatataaaatggtatagtatttgcgtgtaacctatgcacatcctcccttatactttttttttttttttttttttgagacagagtctcactttgtcacccaggctggagtacagtggcacgatctcagctcactgcagccttgacctcccaggttcaagcaatcctcccacctcaacccctccaaggagctgggactataggcatatacctctatgtctggctcatttttgtttttgttttggtttttttgagacagagtcttgctctgtcacccaggctggagtgcagtggtgcgatctctgctctctgcaacctcgcttcctgggttcaagtgattctcctgcctcatcctcccaagtagctgggactacaggcatgcactagcacgctcggctaattttttgtatttttagtagagatcgggtttcaccacgttggccaggctggtcttgaactcctgacctcaagtgatctgcccacctcagcctcccaaagtgctgggattacaggcgtgaaccaccgtgcccctccctcccttacactttaaatcatctctgggttactgataataaatgtaaatgctatgcaaatagttgctatactgtgtcgttgttttgggaataatgaccaaaaaaaaaaaaaaagtctgtgcaaccatccactttattttatctgaatatctgaatcttttctttttttttaagatggagtctcaccctcttgcccaggctggagtgcagtggtgcaatctcggctcactgcaaccactgcctcctgggttcaagtgattctcctgccttagcctcccaagtagctgagattacaggcctctgccaccacaaccggctaatttttgtatttttagtagagtcggggtttcaccatgttggccaggctggtctcgaactcctgacctcaggtgatccgcctcccaaagtgctgggattacaggcatgagccaccacgcccagccttaatctgaatatttttagtctgtggttggttgaatccttggatatgcaacccttgaatacagtgggctgattatatgttttaattaagaaaggttatgtattcagcgagaggtgagagattaaaaaaagaagaaaggttaagttatttgcccaagggcacacagtaagtggcaaaccaggcttcacacccaagtgtgtttgacttcggagctgagaaacttttttttttttttttttttttttgagacggagtcttgctctgttgcccaggctggagtgcagtggcatgatcttggctcactgcaacctccgcctcctgggttcaagcgattctcctgcctcagcctcccgagtagctgggactacaggcgtgcaccaccatgcccggctaatttttgtacttttagtaaagatggggttttaccatgttgtccgggctggtctcgaactcctgaccttatgatccacctgccttggcctcccaaagtgctgggattataggcgtgagccaccatgactgacccagagctgagaatttttaaccccccgtgccactgtgcctccacggatggataataaactcctttcgcgcatgagctgtgtctcccacatctgctatacccctctgaggatctagctcagtactatctagccacatcttacaaagatcttgtatgccttttacttagtacacagttgtttttctccccaaaggcgatggggatctcatttcttagaattacagcaaaaatgttattaaaatgcttagaggaagataagttccatttaatggaatttcctagtttaccaggaatgaaccccccatcctctctgtgcccacaattattgttaaggatctgaagatacccttaatcggcttcctgccttaggacactgtgttgggtatgattgaggttcttgctgttaactgtggtcattgctctagaaggaccctggaagattctctgatactctaggctagtgtgtctcaaactaactctggtaaaggagcagtttttagtttttttgtttttttttttttgtaaatttccaatctgctgttgaccagtatcttggtaaaacacagtaaagaaaaatatatgaaagacatggaaaatacaagtcccaatttttaaatatcaggttagattaatattagatttaaagagctcattaagtaacagaatactctgtccagttgctgtaaatgttctaaatgcatgccctcggtggggtgcagtggctcacacctgtaatcccagcactttgggaggctaaggcaggcagatgacttgaggtcaggagttcaagaccagcctgggcaatatggcgaaaccccgcctctactaaaaatacaaaaattagccagatgtggtggcgcatacctgtagtcccagttactcgggaagcggcggcacgagaatcgcttgaaccagggaggtggaggttgcagtgagctgaaatggcgccactgcactccagcctaggtgacagagtgagactctgtctcaaaaaaaaaaaaataaaataaaaaagaagcatgctctcaatttatgcctttattctttattgcagattgataatgaataataaagagattgtgctccctccccacagcccatcagggttaggctgctcagggtttcctgaagaaaaaaacaaacaaacaaaaaaaacgtaaaaaagagagactggcacctgtccacaggacacactttgaatagctctgccctgggccagtatttcccaaagggtatggtacataagagggttttagattgcatgtggacagacttatctttttaactttagattaatagttctgttgattcttcaatttattttaaaactacaactagtacatcatgctacagtttctgaatattttcagaatgagtaaaaagtgaaaaaactacaaaaactaagcgaaaataagtcaatttaaagaaaaagactatccactgggcctggcgtctaggaaaaaaattttaaaaataaaaagaccaaataatagaagtcagtgctggctaatacaaacagaatgctagccacatatgtaatcttaatttttctagtagacacattaagaaaaagaaacggtgaaattaatataatacaacttacttagtcaagtatgttccaaaatattatctttcagcatgtaattaattaattaattttggggggggcgggaaacagagtctctctctatcccccaggctggagtgcggtggcgtgatcttggctcactgcaacctctacctccccggttcaaacggttcttatgccttagcctcccaagtagctgggattataggcacatgccaccacgcctagctaatttttgtatttttagtagagacagggtttcaccatgttgtctaggctggtcttgaactcctgacctcaagtgatctgcctgccttggcctcccaaagtgctgggattacaggtttgagccaccgcgcccagccccttcatcctcttatgtaccaagttctctcccttaaccacactttccttccctaaagtaggtaaaatttggcaaaacaaccaaccaatcctggcttcccctgtgtgaaaccaggtccctcacaatcctctccaaggatgagcattccttctgtctctgctgaaagaaccagacagcacattagatttcatcattttccccaccgccctctgctgtgggctaccccgagcctaccgcccttgccgtcattactaaacctccaaagttcatcagctctgtgtgtagtcctttttttttttttctttgtagaggcagggtttcgcgctgttgcccaggttggagtgcagtgctgccatcacagctcactgcagccccaacctctcaggctcaagcgatcctcccacctcagctcccaagtagccaggaccacaggtgagtgccaccatgcctggatcatttttgaattttttttttaaatagagacaggtctcatgctgggattacaggcatgagccacctcacctagcctcagcatgtaattaatattaaacgttattaatgagatatctgacattcttttctttgcagcaagtctttgaaattccatgtctattttacacttctagtgtgtctccatttggactgtttgcgtttcacgtgctcaatagccaactgcggctagtggctactgtattgtacggcactgacctagagcatttccatcacgcagggagttttgtggtctacattgagtctcatggtgactaagtattcagtgtgatgactgtgctgtcaagtatggcgtgaagcacagtatgtgtgctgtggtagtgagtccagcttggatctcttcttcatgaatgtagaggaaatggaaacacactttgatggaatgggctcccccatatcaggcaaagcaggcccggattccccaggcttttgaagggatatcctgattttgctttccccagcctgggtgaagggagtgcaccaaggctgtgactagtgggtcctcacacagattattgtcttggggacctgatagactgtggaaaggggatggacttggctttgtgggaattattaagctgtcatcgaggaaaagtgctaaggtttgaatgtccattccaaaactcatgtcaaaattgccattgtgatggcattaagagatgggacctttaagaagtgagtaggccatggggctctgccctcatgagtggattattgttgatagtggattcggtttggcccccatttgctctctctgtatcatgggcttgcttgcccttttgccatgttttgatgcaagaagaaggccctcaccagatgccaagcagatgctgacaccaccagcatccagaattgtgagccaagtaaatttgtttgttataagttacccagtctgtggtattctgttatagccactgaaaacagactaagacagaaagcatggtattgaaaaaacatggaaccataactgtgggaggagagagctgtattagccagcttaggatctcctgggtttggtgttggggtcggggtcaggaatccctgctgctgggtagggtctgctgagtcgggattcaatgggctctgtgagattcgatctggtcatcttccccagctggtgtcatgtcttcctagtgccttgtccacagaagccacttgctgattctgaccaataggtactgattgactgttaggacagatgccctaactctgggaactacaccattaaacagggaagttccagtgtatctgggctggttctgcctccatctttctaggtttgatgtgaaagagctgccattagttacagatggccttagtggactgattacccagcacctgcttcagggcctgcaggatgaaccccttcccagaccagcttgtctccttcctgagcagttggtctgtcttcaccgttggtcactgattccttcagagttgactcttggtttagcaactcaaccagtgtggtactctggttgctgtggtagatgtatgggattaacgtccttttcagctccattttttatccctacccttgtttttctctttctctcctactttctgtatttatttctactgtattttatataagcaatcttaatcttttctggaaggagggagggagggcaggaaatgacctcgcagctggagtctcaccaggcacctgcagccctttattaagcagtgctctatgtccctgtttcagaacaacaccttaatatgtgctattaacttgaagtaaccgtctgaatcgtaaactgggcaaaaccgaattctgctgatgtgcttattcttaaaaacagccccccatgggattcctgtatgttctcttccttcaatacctagcgcgttttcagcactacatttaccagagggaaagtgtattgttcatggggatagcatcacctcttagcaggtgttgctcttttctaccctattaattgtatttgtttagttttcttgatcaccagtcaggggtgacagtgggtggtgaaatactgtgacagccttcagtggaagctttccttgtacctgggtaatttttcccctggtggagatacgtgttatgaataaaatttagcattgatcattttcattagctagataatcaatatttttaagcagttgtagttatgtctacagaccaaaagctcttttaaaaaaatcactaattctaggccaggcgtggtggctcatgcctgtaatcccagcactttgggaggccgagaggggtggatcacctgaggtcaggagttcgagaccagcctggccaacatggcgaaaccccctctctactaaaaatacaaaaattagccgggtgtggtggcgcacgcctgtaaccccatctactcgggaggctgaggcaggagaattgcttgaacctgggaggcagaggttgcagtgagctgagattgtgccactgtactccagcctgggctacatagcgagactctgtctcaaaaacatcataaactaaacattaaaaattatgcattttaattgccattttcttactgcaaaacatgttcctgctctccctttttcctctcctcacccacctaaatttccacttcacttgattttacttttgccagtcacaaatttttttctgaagaataattgcttcttattaatagtccattgagctccacatatccctaatcttctgggatgagattaaccctttttatagaagaacaattaagtgaggaaaatggactgtttcactataccctgttcaactttaatttctcttagttgtgttttagtttctctgtttcaaccaagaggcccaagggttctcagtgcctttctactggggagtgttgaatgtcctttgtggtacatagttttatctttactgcttaaaaatcaaaaggattatttacactttggcatgtaaagattatatcagagcaaatggctcttaattcaagcagagataagacatgcaaggtacaacactgtccagtagaactttctgtgatgttggaaatgttctaggtctgaactgttccatatgatggccactagccacatgtggctgttgagcattgaagacctgagtttttaattgtttctaaatttaaaaaaattgaatttatatcagcacatatagtagtagcttctgtattggactgtacaattaactagctgttgactaacctcgacagattaggatcaggaatgaggaaggagtttcagatctcaaacaaagttacttcaaacccacctactcttggtttctcctgtacaggctttgatatttggcacttgtcattcaaccactctcagatgctggtaggccaccaagaacagaaccagcagttagctccttgacactgtatcaggtctgtaggacagtgatcgaactggtagacaagacttgttcctggctccgtggtggccctggagtgcccacagtcagccaatcctctctgtcctgtctcagcttttcaacttggcacaactgaagagtaaaaactggagccagggtctttagtttcacaacttggttggagaaaccagattgacttacaagccattaccaaaccattagataaaaccagtagctagctatgcaggatttgggtgagctgtgggcagagcttttccagcaaaaggttggcagggacctcaaccacaccctaggccagagaaccccgtggcaggaagtgaggttggtgggggcattggatgcctttgctgagttaatcgtgttccctgttctctagcaagtactcagtaaaatggataagtctcagctctttcattctagcttgctccttacaaactgcggcctcagacattggcccctagaactcagttgcttgtctgtacaatgagattgtacacaaggtgatcttactggtgcgttccaactctgtgatgctgtgatcctccacagctggcctaggaagcagagggaagcatatggctgctatctacccttctcattagtgggatcaccagccacatagcttagaacgactcccccccaccccgcccattacagccaaacccgagggttctgccttctttatctctcatgaccgcatccccatggccagtgctttgggtcagactctgtcatctagagcctcaccagtatcagaagaaccttagggatctctgtccgtccgtccaggtcaccgtccctgtcatggatccttcatgtcattctcttgctttaatctcctctgacacttgcctagcacttcttaaagagtatattctaaactgctgttggagttttcaggcatgttggaatggggctccaatttacccctccacccccatctctctggcctgtaaccactcccgctcagaatgttcagcacactttgcacgtgactgcttgtgtacatgctgttctcttcacctggaattcttttcctctctgtgtctgccatcttcattcctgtctaccctgttcatctttcagtacttggctcacacctcacctcctctctgaagccttccccaaccacacacacttttgatggttttttcccttcttattcattttccattacagcattgattatgaaaatgcagataaaccatgtgcaaataaaactgggactggcacttggaaactaaagtacacaaatcttaagtgcacagtctgattatgtatacaaccatgtaacccacacccagatcaagatgttaaatactttcagtacccagaaggctccttcatgcctcctcctagtcaatacttctctcaaaggtaaccactgttctcacctcttttcactatagatttgctttgcttatttttaaattgtattaaaatagattcatttaggagatacttttttattgtgataaaatatatgtaacataaaatttactgttttagcaattttgaagtgtacagttcagtggcattaagtacattcatgttgttgtgcagccaccaccacaatccatctccagaactttttcatcaagtatatccttctttgtgtctctttttgttttcttttcacttgacattatgtctgcaagattcacctatgttgtcacaggtaccagtggttcatttctttttatttctgagtagtagtactttgtgtgactgtatcacaatttgttttatcaattctcttgctggatggacattgtttttttccagctttttattcttttgactaaaacttttatgagcgttatgcttgtgcagataccttgatgcccatacatttctgttgggtacatacctagaagtggaatgggatctgaaatgtcacttcatagattctatataaagagtgtttgtaacctcctgaatcaaaacacaagttccattctgcgagataaaatgatacatcacaaagcattttcacagttagcttgtttctagtttttatcgcttgatattcgattttttcttataggcctcaatgggctcagaaatgtcacctcgtagattctacaaaaagagtgtttccaacatggtaaatcaaaacacaggttccattctgtgataggataggcatgtcttcagcattagcggatattgccaaaccattttccaaagtggcttgtattcatttcttattgctgctataacagattatcacaaactttagtggcttaaagcaaaataaatgtattatctcaattccagacgtcagaagtcttaaaatcaaggtgtcagcagagcctttcaggatgtgctaagggagaatctgtttccttgtcctttccaacttctttttttgtttgtttgtttttttttttttttgagacggagttttactcttgttgcccaggctggagtgcagtggtgcgatctcggctcaccgcaacctccgcctcccgggatcaagcgattctcctgcctcagcctcctgagtggttggaattacaggcattcaccaccacacccagctaattttatatttttagtagagacagggtttctccatgttggtcaggctggtctcgaactcccgacctcaggtgatctgcctgtctcagcctcccaaagtgctgggattacagacttgagccaccacgcccggttgtcttttccagcttctagaggctgcctgcattccttggctcatggccccttcctccgtcttcaaggccagcatcatagcatcttccaatctctttctctcttgctccttcccctccctcccccccagctctacttccactgttacatctcttctctctaactcacctacctctgttgtgattaccttgggcctacttggaaaatcctggataatctccccatctcaagagccttaacttgatcacatctagaaaggtctttttgttatatgggatagcatattcacaggttctgggagctagaacatcgacagcttggggccaatattttgccagccacatggctgtaccattttgtattcccaccacagtgcatgagagttctagttcctctccatctttgtcagtacttggtatggtcagtcttttgaattgtagctatactggtggagatgtaggggcaagtccaaggctgccaccccaggcagtgcatcctcctttgctccagtgatagctttattgcaacttataagcattatattatgaatatgtatttacattcctctgtcttagccaaactaagcaccacttcatgagcaggctatatagtagttgatttaataaaaggtccttggatgcgaagaactgactgagggcagttttcagcagagcagggaagcagagctgaagatataaatgaaagcccatgcttccagtctcaactctgctcagcccccaggatctgagggaagtaggatttccctcaaataaaaataggagtagagcaaagaacctggcttccaccttctgcacactgttgtctttcccaagatagttaatctataagtgagtaatgccctagaaggaaatttgggccttgactcctatgggtgttggttggaaatgacttcactgtatatgtaaatgagaggaaaatacagttccagctggctactggggagtctgatcttggaccctttgcagggactcaggttttccttttccttggactctgctcatgtagcaacatactgcagcttcttacttacagaaggaaagactccaaggtaagtaatgctttcttgatctcagggaatgtctgtcatgtgtgtagacttaaacccaccttggaaacttgaggttggaatgtctgcagaaagtgaagccagagtagagatgaatttccaatgcccctggacacaggatggtgggcacagatgtcttcgtactagaaaagaatctcggaaggtgggattagtattagataaaaggcagacaggatgatggcttctttcgggagcatcctgatgcaaataagcactttctgggttctgtttcattccctagtttactttgctgggcacacacctggtttcatgagggctgtaaggtttctaggcttcattcttacctttctaggctgccgaggtgttagcagcattcctgcagcttggcattgctgtgacctgagagagagagagagagagagagagagagagagagagtataaacttgcagtgtggcagaggacttccttggccctcacaaggtcaaccaaaacctggctggttggtatttggatcaaaagggagtcggtctttgaagaaaagcattatctcaggataggaggtactgtgacaggcctgtgccagagttattggtccctgtttaaaaatgtactgacagtgtcacagctttagtaatttaataagtacatgtgtggttcacaggctgatctgaaacaagctggctgtgccagagtgggtcacacctggaccttgagtagtgtggatggcacacacaccatgagggttgggacagcctgaaccaaactgtggccgtgtgtttatggagtgctgctgacttcttagacatccacttatctctgcctgctgtgtttgagatgtggaaaatgtcaggtggcagcattcatgctgagaactgtccccctgggatttggactccctctttactcgctgccatccaggtctggaggtgatctcgagaaagaatatggggtgagctgtcctctgtaatcagatgggtgttcactttttccaggacaggcactggatctccgctcaacattctctggggctggaggggtacccttcacctcctgggtcaggaagctctttatgttgatagaaacatgtctcctcttgctacccgctcccccccccaccgtgtagagagcggacaaccccttggcatccttttcacagaacttctaagtctccataaatgtggggaccaagagcctttctgtggcctacaccacttccagttgtttaaaccctcctggtgtaactttttatttggagtttactcctgtgacattggtgtctctcttctctaactgtttgcacaaattgtccatagtgagccctttcatctcagttaagaatttcccacttaatctgatcacctactggcttggccactaactagctataggacctggccacaggttagtttcttggcctcttctttacctgtgaaatgggaacatatctgaaatacttcatggggttgacaggaggattgtgaagtgttgcatggaaagtgtttgtagtgcagtgtcttgcacagaggtagtactctgttaagtaggaggggagcttatcatccgtgtagccagtacgaggacctaggctggatgtctgtggacataaaaaagattttttgttatagtgtacacttatatcaatatagtcatattgatatatttatgtatggtctttgccttccagggaactagtaacctagtgagataggttgtctctaacttactgtaatccaagttgagcattgataagtaccataaatgaaaatagaaaaatggaccataaggctatagatgaacagttcattctggctgagagctggggtcagtttttgtgcatttatgagtcccaaaggcaagtgatttttttgggagggacagtcacttatactttggtggcccatggttagcaggacagcacttcccacctggaagtggcctctatctttggccacgttcttcagtttctgcatagaaatgacatttctttttctcccacctagtgcttaatttatgattgaaattcttgaagtatccagtgatgccctattcaggaggctgtccagccagtagcattcctttttattcgttgcctaatgcaacactgacagtagcgttcatttttctcttcctataagtatgtcaaagtctcttatcctaggtcctagttctcactgtcctaggtgagctttctcttcccactttgtgcagttagtatttttccacagacatagaagaagaaaagagcactcttgttttttggccccacccctctttggcacacactacttaggtgcttcaccccacacattggcccagagcttaagagaaggtcatctgactgtctggagctgtggaaactgcacatggcttttggcaagagaatcttgtggtgtgctataagtttttaagtttaagagtttacactctgcactggataatatggtaactaattccatgtgtggctacttaattaaaattaaataaaagtaacaattcagtttcttgattgcactaagccacatttcaagtgctccatagcccagttggatggcacagatatagaacacttctgtcattgcaaaaaattccatgggacagtgccggtctagggggttgccttatagttgtaggctactaataggaaagatagatgttcattcaggcttcagtggtttagattttcctcctgaatgacccaagttgaatgtctaagctttaaatctcatcaactaatgcaattaaaatattttaaccttcttaaatttgaatacaaaaagggtattcattttctgaagtcttttttgtgctgccgaattaccctgaagtagatagcaagtgtggattcttacaggtgaggaccttaatttgttttttattgtggtagaatatacataacataaaattcaccactttaaccattttaagtgtacaatttagtggcattaaatacattcacaatgttgtgtaaccattatcactatctgttttcagaactttctccatcatcccaaatacaacatatacccactaaataataacttccctttccacctccccccagtctactttctgtctccctgcatttgcctattctaggtacctcatataagtggaatcataaaaaatttatccaatgtactgactcatttcacttagcataatatcctcaaggttcattcgtgttgtatgtataagtagtatgtgtcagaatttcttttttttctttttttttttttttttttgagacaaggtcttgctctgtctcggagactggagtgcagtgatgtgatcatagttcactgcaacctcgaactcctgagctcaagtgatcctcccacctcagcctccccagtagctaggactattggcgtgcaccactgtgcctggctaattaaaaaaaaaaaaaaaaaaaggacagggtctccctatgttgcccaggctgatcttaactcctgaccttaagcaatcctcttgtcttagcctcccaaattgttgggattacaggtatgagccactgcacccagccagaatttcttttcttttcttttctttttttcttttttcctttttttttttttttttttttttttgaggaagagtcttgctctgttgcccaggctggagtgcagtggcacaatcttggcttacagcaacctccgtctcccggtatcaagtgattctcctgcctcggcctcccaagtagctgggattacaggtgcccaccaccatgcctggctaatttttttgtatttttagtagagatggggctttgccatgttggtcaggctggtcttggactcctgacctcaggtgatccacctgcctcagcctcccaaagtgctgagattacaggcgtgagcctctgcacccagacttcttttctttttaaggccaaataatatttctttgcatagatataccacattttgtttatccattcttttgttagtagacattggggttgcttcccccttttggctattgtgaataatgctgctgtgaacataggtgtgcatacatctatttgagtccctgcttcaattcttttggatatatacccaaaagtggaattactggatcatatagaaatgctatgtttgaccctgttttgtgccaggggagaagtggggagacagggtgggtcttgctctgttccccaggctgaagtgaactggtgcagtcgtagctcactgtagcctcacattcctgggcttaagttatcctcccacctcagcctccaaagtagctggaaaaacagtcacttgtcaccatactcagctaatttttaaattttttgtagagatgtggtctcactatgttgccaaggttggtctcgaattcctggcctcaaatgatcttcctgcctccacctcccaaagtgccgtgattacagacatgagccactgtgtgtggccttggccctgattgaaaaacaaacaaacaaacaaacaaacaaacaaaaccttaaaatcattgttgagatataactcacaataacataaatttcattcttgtaaagtgtacatacagcccagtcgttttaaatatattcacgaggtcatgcgatcatctccactagtcactgattttttttttttttagacagagtctcactctgttgcccaggctggaatgcagtggtatgatcttggctcactgcactgcctgggaaaacaggcgtgagctactgtgcccggcctagtcactgatttttatagcctcttaggactaaagggagagggagaatctagaaagtggcttgggtgcaaggaagggagctttcaggattatgtataatactcttaaaacaggatatttgttaatcctagcactttgcgaggccgaggcaagcagatcagttgaggtcaggagtttgagaccagcctggccaacatggtgaaatcccatctctactaaagatagaaaaattagctgggtgtggtggcacatgcctgtaatctcagctacttgggaggttgaggcaggagaattgcttgaacccaggaggcagaggttgcagtgagccaagatcgtgccactgcactccatcctgggcgacagagcaagactgtcaaaaaatatatatatatatacatatatatgtatatatatatatatatatatatatacatatatatatatatatatatatatacatatatatatatatatatatatatatatgtatgtattttttttattaccaattccttgaaacgtctcataatctttagcaacaatcctctgcccactgcgaggctttctgacctgaagtttagaaaggctcccctgctacctgacatattttcagctactcgtgaggccttgttttatggaacgggatgttgaagaacctcacaaatgggtcagactccccagcaatgctctggaagcctgcttctataggagcagacaggtgttcatgtgctataagctttgtcacatgcccttccctagcagggaactacttctgttccttctctggttctggtcctaaattctgaagctacttgcatttccaaacataaagcaagttgtttataataaatgccttaaatatttgattttcagattcatattgctctgctttggaacaaggaatacaactcctctgcttttgttattacaagccatttatacatataccagggtgctctggttttcacttgttctcatcctttagttgtggttttaatattttgtgctttggacatggttttattgtggttttcagatacatggccagttttcttttctttctttttttaatacgtcatacaattcacccctttaaagcgttcagttcagtggatttagcatattaagtcatgcaaccatcaccacaatcaattccagaatattttcatcaccacaaaaagaaatcccttacttgttttaccccaaccccctgccctaggccacccaactactaatctcagtctctatagatttttgaccagcgttcttgcattcttgtttaatggttattttttatttttatttttatttttttttgagatggagtctcactctgtcacccaggctggagtgcagtggcgcgatcatggctcgctacaacctctgcctcccgggttcaagcgattctcctgcctcagcctcctgagtagctccgactacaggtgcgtgccaccacgccaaactaatttttgtatttttagtagagacggggtttcaccatgttgaccaggcttgtcttggactcctgacctcaggtagtccttctgcctcagcctcccaaagtgctgggattacaggcgtgagccaccgcgcccaggctaatggtgactttcttcctctctaaattataatataagccaccacccttttttccgtctctgttccatttttgtcttttccccttccctccctcccctcttctgatattagcaggttagctctaaattctccttaattagctcccaaaccggatgaattggtggatgtggcacaactgcaggaattcatccaacaaaccagggatggacaaatagtgtgtttgagccctcgaacacccttccaagtcatctgccttcattctgtcactatgaggccagccttcttttcactggctgggaggctgtgggaactgcgagctaggccagcaagagagaactgggtggaagctggtctcagattgatcagtcacacagcctggggagcaatgaactgagatttcagtgtgtggcccatgtgagtgagtactgggacagaaatcaaatgcttgccttacaaatgtagtgtccagatgtataaattcagccactggatcctcctatcaacagaaacatttaatagtcaaattacagtttcaaaatcagtttacaaattacagtctgaaaatatcagtatttaacttgagaagcactgttactcgtacctggtacagagtcagaactcagtgaaacttcccctttgccctctgaagttttgctgaaaagtgaactcacaaaagacagattaattagagaaaaggcatacacattttattcacgtttatacagggagaaccatgagtgactacctacctccaacagggttcagaggctttatataccatcctggcaaaataagttataagacgggggaagaagaggaattctgttgagaggatcactagggagaataagtggacaagataacttgtatactatcttgtgaacgggtctttcaggtgtggttacattcctggtcttacaaggaggggaagaaaaaaataaatgttccttttggtgggtctggactttaggcacataaaggaacttcaacttcgtcctgctttgggagagacattggtagggggaggagggggaaggtcagagagaccttgaggcttcttcagttcagtacgtcaaagtgccatattttgggatatctgcttctgagccccaacactgttattaagaggccatattttattgtaagcctactgtatacaaggcacaggttaggttttgtgaaaaataagccaaagcttcttgaatggaattcaagccctatttatgttataatgtgcaggagtttagcaggttaacactggggaagcagagacttggtagcatccacattttgcttgtttctttagaaccatatattttattaaataaatttttataaaacaatgtgttaactgtagataccctcaacacaggaaaggtttggttaagcttagattcttgctgggaattgtagatattataatttcttgtggataatttaaaaaatttatcatttactattggccactggtagctttattcaaggcaaaccatcttgctcaaaacaaataaccttgaccaaaaaggtagccaggatcctatttagtctatctacagattgtttttggttaaaaagacatcagtgtttgttccatgccatatatgtatctcctgtttcattacatctccgtattgctgggaatgaaacgagtaccagcaggcccttgctgtggaattttctgagcgaggtcagagagaagcacagtgtacttttagaacaagatctgtcctgcctttttttgtattctggagtacacttggggagaaatagagtaagctgctgtttggggaagaagtttgggcttttgatttattttgaaggagtttaagaaatgctaccaccatgcctggctaatttttgtatttttagttgagaagagatttcaccatgttggccaggctggtcttgaacttatgacctcaggtgatccacccatctcggcctcccaaagtgctgggattacaggcgtgagccaccacacccagccaatactagttttttttattgctaaagagtgttctgggccgggcacggtggctcactcctacaatcccagcactttgggaggcagagacaggtggatcacctgaagtcaggagtttgagaccagcctggccaacatggtgaaaccccatctctagtaaaaatacaaaaattagctgggcatggtggtggccgcctgtaatcccagctactctggaggctgaggcaggagaatcgcttgaacctgggaggtggaggttgtagtgagctgagatcgcgccactgcactccagcctgggcaacaagagcaagactccatttccaaaaaaaaaaaaaaaagagtgttccactcacagtgaatataccacagtgtttttgctccattgctgttttatccattctttctttcttttttttttgtctaagatgaggtctcactctgtcacccagactggagtgccgtggctctacctgggctcattgtaatcttcgcctcccaggctcaagcagtcccacctcagccttctgagtagctgggaccatagtcacgtgccaccatgcctggctaagttttatccattctcttgctgatggatagttggactatttccggctttgagcaataatggataaagatgctgtgaacatgcatgtgcaaaccaccttgtggtcctgtgtttgctttatttctcttgggtaaatccctcagggcgggattgctgggtcatatgtatgttttaactgtggaaagaactgccaaatcttttcccaagtggttgtattcttttacaccctcacctgaagtgtatgaaagttctaactgctttgcacctttgccagtacttgctatagtcaatttttttgtgggatttaaattttttttgccattccagtatgtgtataatggtatgggtttctcattggttttaccttgcatttccctgatgattaaagatgttcaatattttttcatgtgttgattaccatgtgaagtgtttgttcacatttttttttttttttttttttttgagacagagtctcactctgtcgcccaggctggagtgcagacagggtttcgctatgttggccaggctggtctcgaactcctgacctcgtgatttgcttgccttggcctcccaaaagttctggaattacatgcgtgagccaccatgcccggccggattcggcaactaatttgtacatcttaaagctcctacaagtttatgacacattattatatggcagaaatagactaaaaataactttctgtgcaaaaatagttctggaagtcgtgtcacagggctcttggcccagcagggagccacttttaactagagctaaaagccagcattgtaaatagcatagaattgactgtaaagaggcaaaagggaatgttttgggatgatggaagtgttctaaaacttgattatgggggtagctgcaaggctatataaattcacagtggtcacttaaaatgggtgaactttacagtatgtaagttacacctcaagaaaactatagtaggaagaaagggagaagggggaacgagggaggagaggaaaggaaaaggaatagaaaagcaagcacaaatataggagggcattgttttgtaaaaacccatttcagctacagaaatatgtacattgtaaatatgtatttctaattgtggagttattaatgatctaaaacgttggaaagctcctgctccaagggaatgacatctagggcagtgctttgcaaacttgatgggaatcccctggggatcttcttataatgcatttcatattcaataggtctggggcagggactcagagtccacattttgaacaagtttcagctcatgctgacattgctggtctgtggacctcacttctgagtagcaaggactagggcataaattgaggctgagctattgagaatacacaaacttaatactgtcattgttggaagggtctttagaaaaatctagtacaatatttcccaaatggacatcatcatgagaaccttctaggggtacttattaaaaacacagattcctataatcaagacagtgtgatactggcataaggatagacaaacatatcaatagaagagactgcagagtccatatatgagtaattgaatatttgacaaaggtatcaagataatttaatggaaaaagaacagtcttttcagcaaatggtgctggaacaactgaatatccatatgcaaaaaatgacccgtgattgataccttgcatcatatataaaaattaactccaaaatagagctaaacctaaagccataaaacttctagaagaaaatacaggagaggccgagcacggtggctcacacctgtaaccctagcactgggagaccaaggcgggcaaatcacttgaggtcaggagttcgagaccagcctggccaacatggtgaaaccctgtctctactgaaaatacaaaaattagccagaaattgcttgaacccgagaggtggaggttgcagtgagccgagatcgtgccactgcactccagcctgggcaacagagcgagactctgcctcaaaaaaaaagaaagaaaagagaacacaggagaaaaccttcatcaccttgggataggcaaggacttcttagaacacaagaagctcaaattataaaagaaaaaaattgataaatcaaaccatcaaaaattaaatcttcttttcttcaaaagacaccattaaaattaaaaggcaaataagatgaggagaaaatattcacaataaaaatgtcagacaaagaactgtgtccaggctgggtgtggtaactcacacctgtaatcccaacactttgggaggctgaggtgggaggattgcttgagcccgggagtttgagaccagccagggcaagatggtaggaccctgtctctgcaaaaaaaaaaaaaaaaaaaaaaaaaaaaaaaaaaaaactgaaaattagctgggtgtggtggggtacacctgtagtcccagttaccagggaggctgagccagtaggatcccttgagcccaggaatttcaggtgacagtgagctatgatgatgtcatggcacactccagcctgggacacagagcgagactccgtctcaaaaaaaaaaaaaaagaaaactattgaccaaccttcttgtgaataaaatataagcaaataaaaacatcttgcagctcagcaagtaaccccaaaaatgtgcagatgtgaacagaggctgggcacagctcacacctgtaatcccagcactttgggaggccaatgcaggcagatcacttgaggtcagaagttcgaggccagcctggccaacatggtaaaaccctgtctctacaaaaaaatacaaaaaaaaaaaaaaattagccggacgtgatggtatgcacctgtaatcccaactattcaggaggctgaggcaggagaattgcgtgaacctgggaggcagaggttgcagtgacccgagatagcgccattgcactccagtccagtgacagtgtgagactccgtctcaaaaaaaaaaaaaaaaaaaaaaaaaaaaagaaaagaaattagttgctggatccataagttaaaagaattttgaccttcttaaactccccagttgacttgtgacatgtttttaagcctggacctgctatttgcttgtgtgttagaccatgatggttagcagagaggtaaaatgattttaaatattttactaagtaatagtcacatgtgtctgaaatactgtaatttctgaaaataaggctagatttgtgaagttttattgccaagacaggctctgaaaatctttccttaaatgaattagaagcccagagttgaatatgttgttttagtctgtttgtgttgctataaaataatgcccgaggctgggtaatttataaagagaagaggtttatttggctcatgattctgcagactgcaagaagcatctgcttctagtgagggcctcaggctacttccactcatggtggaaggggaaggggagttagcatgtgcacagaccacatgcagagatagaggaagagagagggaggaaaggcatgtgctgggctcttttttacatccagctctggagggactctcatgggaactaacagagcaagaactctcattaccacgagcatagcaccaaaccctcatgacccaaactcctcccacctggctttaccaccaatcttggggatgaaatgtcaacgtcagttatccagactatagcatatgtgttacaggtttctgttgtgaagtgaaatatattttcctttgtaaatcatgcctttaagacaaggccttgcctttcacctctaggcaactgtcactccccccaccaatgtgttattctggagtcagactgcctgagtttgcaatgcacctctgccacttaaccagttctgtgacctcaggaaagtgtcttaatgtctcagtttccccacctggaaaatgggtacaataatagtacttactgcatagatttgttaggataatcaaataagtgtagacatgtaaagtatttagggaggctgaggcaggagaattgcttgaacccaggaggcggaggttgcagtgagctgagatagcgccactgcactccagcctgggcaacagagcgagactgtctcagaaaaaaacaaaacaaaacaaaacaaaaaaacagcatttaggactgtgcccgacatgatcaatgttgattattatcatcatcattattattgctatcctcattatcattatttctctaaactggctgttgtcgaaatctcttattaagctattttccatgcctcccaaattctttaacaactaaacttatggcttttcccccaagtctcctgaggctgcttcctatttctgcacatttccgcatacgatgccaaccactgttctcctggcttcctgggccgaaaacttcagatctcctttgactctctcctccccacctccattcagttgcctatatgtgtagtgtctaccttttcatactagaattatcctttcctttccattcagattctaatcacctctcatctggattattcatttatcgtgtagctgaaatgggaccgtgtagctgaaatgggaccgtgtagctgaaatgggaggacagggttcccgtgggcccagccctggacccacctgtgtgggataggggacaggagcagctgggaagacaggattgggtgcgggacatggacatcagcagtgtgagggacaggataaggaaaggacagtgagaaggcggctctgagaaggaccggccacaccttagggcctgcctgtatttgaaatgcctttattagcttttgcatattcctcacagacatctctttgcatacaatgaaggtctttgggtgaattggatgaaatggcttgttaccagcttgaatgatcacttagaaaaaaactgcgcaggcctgcacggtggctcacacctgtaatcccagcactttgggaggctgaggcaggtggatcacttgaggtcaggagttcgagaccagcctggccaacatggtgaaaccccatgtctactaaaaatagaaaaattagctgggcatgttggcggatgcctgtaatcccagctacttgggaggctgaggcaggagaatcacttgaacctgggaggtggaggttgcagtgagccaagattgcaccactgcactccatcctgggcagcagagtgaggctttgtcacaaaaaaagaaaaaagaaaaaaacttgagaaaacattttaccctgttccttctctttatctttgtttcttacatttagtgaccatattggctatgtattgtgtgcatacaaccatcacgccctgtccttagcagagaactccaattttgaaacctcagaaggtggatactgtgctcgatgaaagtactcagtgccatattgatgagcggaatgttgggttaccttgggaacacagacgtccttccttgttactataaaaagggccacagtggctgtggttgtaaggcaacctacattttactgattctttatggtaaaaacgtgcctgtagggaaatgctgtatttttttaagaactttgatcagatacatcagacttccttttagtgctgatcaaatcaggtaaacccagttttcagtacttacgggtttttacaagtatcaaagctgtttccatccatccttcttctcctctttcctgtgcccacagtaagtaggcaggatatttgttgtaagactcaatatgaattgttttcaccaacagggattatgactaagagtataatttatactaatgtccttaggaggggacttatttgcctggtagggcctgtataggtcatatgaaggcagatggcgtgtgtttgacctcctcagggtggcctgttgagcagggttgcctggccaagtaagccttcccactccagattgtgaggcagctcaatgtgtttgcctcgcttgcaggttcctaccatggtttcactgtactgccatctgggaaaggaaggttggtgcagtttattccataataattaaaagccttaccactactaataaggcgtttagatacagccctactggccgggtgtggtagcttacacctgtaatcccagcactttgagaggctgaggcaggtagatagatcacttgaggtcaggagttcgagaccagcctggccaacatgtcaaaaccccatctctattaaaaattcaaaaattagctgggcgtggtggtgcgcacctgtaatcccagctactcgataggctgaggcaggagaattgcttgaaccagggaggcggaggttgcagtgagccgagattgtgccagtgcactccagcctgggcagtagagtgagactctgtctcaaaaagaaagaaagagagagagagagggagggagggagggaacaggaaggaagggagggagggtacagtcctacctaggggaacaaattatgcccattgatgctgtcaaacacctatcagaagtttactaattctctgcgattgaagaattattttattattgctaccatttttaacaaagccacccaaatgggaatcgtgtttattttctttatcgttttctgaggttttatattactaccgtatattgatgtggcatgaaccaaggtgtatacactgtgaagaaggtttttttattcgtcacatgcagtgtagcttactacagcaggcttccttacccttggcactactcacttttggggctggatgattctttttttttttttttttgtgagtcttgctctgttgaccaggcgggggtgcagcgatgcggtctcagctcactggaacctccgcctcccgggttcaagtgattctcctgcctcacactcccgagtagctgggattacaggcgcgtgtcaccacacctggctaatttttgtatttttggtagagacagagtttcaccatgttggccaggctggtctcgtacccctgacctcaagtgatccactcgtctcagcctcccaaagtgttgggattacaggcctgagccaagggctggatgattcttgtttgaggctgagggttgtcctgtgcactgtagaatgtttagcagcatccctgacctgtacccactagatgccagtagcacctccccaggagatattttggagtctcaaaatatctccagactttgccaagcactggggtacacagtctcccctggttgagaaccacagtattagaatgtaaggattgtgtagcttgctatttttaaaggcagtggtcatctgaagcactagttttcggtcagctataatagaaatgtatgtattgacctttaagtatgacagtttggctaacttaaaataatgtggtaaatccaaaacccgattgctgtgatgtgctagcatgcttaaatagcaacagcatattgctgttctttgatgatcgtttttacagatgaatggcaacacacaggatttgaaaatgcatatatcatttatttttatgttcctgaaatgaaaaggaaagaaatagtgacagccacaacagcccaggtaccatccatactcaggcatacctgtagtgcacatgggaaaagcacttttcctatgtgttattttggaatggcagtggccttttctgtggaatggccaaaagagaagcttgtacatgtccataaaccttgggaattctcccctgaaggcctcgttgttttacttttcacaaatctttcccagaaccaaatattcagttccacggtttaccttttcttttgtatcataatctgtagttttactattttcaaaatcaacttttaactactggcagcaataaattgaactttaagattcatggttcttttgttttccaaagagggttttagcagggatgcggttagaggctggaggtgggttagatagaggtaaatttaattgacaagctagagataactgcgaggctgtttaaaaggccaaccagactgccctgaacaatgttgaatgcggttacacattgtactctgcttttgtggtttaaaaataatctatctgtggccgggcgcagtggctcacgcctgtaatcccagcactttgggaggccaaggtgggcagatcacaaggtcaggagttcgagaccagtctggtcaatataatgaaaccccgtctctactaaaaatacaaaacattagccgggtgtggtggtgtgcacctgtaatcccagctacttgggaggctgaggcaggagaatggcatgaacccaggaggcggaggttgcagtgagccgagatcgcgccattgcactgcagccccgacaacagtgcgagactccgtctcaaaaaaaatacaaaaataataatctatttgtgccatgaagctgtttcctcaaggcctcaaagtgcccttgaagattgtccttgtttaagaattatgttgtggctggactgaggatgccagacgcacagatctgtaggcctaggatgggggtaactctgctgggcatgtttttcagagacaaatggaaatggaacaggggttctaactttcaaaatcatttttaacctgtctcccaattgttgtaataccaagagttttactctctaattaaaaaaatattttttgtagagacagggtcttggtatgttgcccaggctggtcttgaactcctggcctcaaacgatgctcccactttcttcctaagcactgggaatacaggcatgagccactgctcccagcccaaaagagtgattttttttcctagcccctttatttatcctttgcattttgttttaaaactaaggaatcttcttgaaacggaagccagctggtggtaggagcaggcctaagcactaccctgatgacttgcattgctcttcagtagccttgtcagtggcctctggactcagtggtgtaactgggaccatctcttctgtgggctggaattgccatgagctaagttggaatagcagggctaggagagcaagcagttcacattgggtagtttgtgctcagcagtgattaaagctcagatctgggccgggcgcggtgggttatgcctgtaatcccagtactttgggagtctgaggcgggctgatcacctaaggtcagaagtttgagaccagcctggccaacatggtgaaacttcgcctctactaaaaatacaaaaagctgagcgtggtggtgcacacctgtaatcccagctactcaggaggctgaagcacaagaatcccttgatcccaggaggcagaggttacagtgagctaggatcgtgccactgcattccagcctaggcgaccgagtgagactctgtctcaaaaaaaaaaaaaaaatcagatctgatgcccagtgagatggccaaggaagagttgtcagcctaggaagaaggggctgtcctcagggaaggggtctgaagggtcctgttaaccctgtaacagtgaggttggagggaccccaaacaaccacatacatgtaattgtgcagaaacagaaacaaggaatgaggacaatataatcagcttgagacaaagagcttgcagttggcttgctcatactcaagagtgcagcttgtcctatggtagggacctggggccttatgggcatctgggccaggagtgccatggagattggctggaaaggtctctggtgagcctttgggatccttttttctttctttttctttttagctatctccctataggaaggatgagactcttttacatcttttactttcatgttattaaacacacatacacatcaccatgaatagaaatcaaatgacattgctaatactggaaactccacaggtaatttctctttaccagtcattacctgctgggttctgtccacagtttaaaagagatatttgtacatttcttgtgctttgttgctgagaaaaagcaacaagcttctaagcaagagtcatttatccccgtgtcttggccctctttccagaagctcaaagcctttctgagtcttgtcttggattggtgagttgggagcttgtattttcacatgacacaaccctcattgagcaaccgcttctcctgatatgtaacctgaaagccagcctctgccccaccattacaggaaaatactggctgggttaggctgaggaataatgatgcctgacatttattgagcagtgcttgtgtagcgcatagtgtactgagcagttccctcttttccctcctcctgtttgcatcctttccctctcaattaatgctcctagtgatccagtgagtgggcgcgatctccatggggttagaacccaggctacctggctctggagcccctgctcccagggcactgtactcagctgccctctctgtacttgctgggggatgtgggggtgctcttcaagggtcattttgtctgcatgattggagccctttatcaggtgagactccagaagctcacgcaaaagccctgcatgtcagagcctctccatctctaaaggacctgaggccaagttcagatgcccagacctacatgccctgtccatggtagaaaactctacccttgctgccctgtccatgtttactgccttatctcattctagccccatttgcttgttggttttttgggatcaccttgtatagggtgggtagaatccacattcttgttgttgaagaacaggcatgcacaaaaaactgtgatgaacagaattacacagaaaggagagcatgaaggtggaggagagatgatcttgcaaccaccgcacagggaagaaggctgggaggacagacctcagcatagagtcacccgtattaccttagggagccctgagcttagctgtataggtttcttttaactagcaaatcatgctgtgaatagaatatgctgtgcatattggcttattttgaaattacatataattgtagaaacacaggaagctaggtaattcctgcctcccagatgaggatccagggtgggagctaagctttcatatcatggtgcccggtagataatcagttgagtttaatttttctagactatgtcttccttcgctacctttgagtttgctcatcttagcttctaagcaaactatcagcttggcagagaaagccttagaatgaaaactgtgacctcttaggaagttgtggggggtttcctggagtagttttatggggttcttgggaagactgaaatgattccaggatttggggcccagtggtcatctgccccaacttgttttgtctgtgttctcttctatcatcaggggaaaggagccaactgtgaatactcctgcatgccaagcattttcaaaaggtcttgcctctaccccataaccttgggatgtaggtagtaatgttcctattttatagaagaggaatttaaacctctgagatgttaaggaatttacccagtctcttgactaggatacagttgggcaggccacatggatggagccaagaagaagctctcagggccgagggggctgagctttatctatgaatggggagaaaatccaattgaggcagttttactgtagctgtagaaagaaccaggcctttggggcatttgtagctgggatctgatgtagactggagacagttaaaagcatgagaaagtcaggttaacagttaccctggaagataacagctgtcaaggaagagttcaggaccaacgaaccagcttcttagatttccttatcttctggtaaccagcaaggttaggcctttttgccatgctctttctcttcagccactgcctgggcctttgcaggtgacttcagttcccatgctggccctggcagaaggcatacctcctatttcccatgctgcccttggagtccaaatacaccccacttcttcacagggccacagtgaagatgtggttacctgggagttgccgggttattcttcatagctttgggcactaacaacatatggcaggtggtcagcactgaattttgccttttctgtttgttgctgtagttgttacagctttgaaaataggtataaattacatacactacaatgcacaaattttaagtctactgtttgatgagttttggcaaatatgtacactctcggggcctagcctacccaatgggtcccccactggaggcttggggcaagctgaagacattgctgatgtgaaaacaaggattaaagatcagggagggtcaggggctggttctagactgtggtagtagacatggtggtggtcaggtaatgagattaaggaatactcatgctttctggatactcaggacatatctcatttcagggccatatctaaaccagtaataatgatgataatactgttagctaatatttattaggcatttaatatgttctaagagctttgcatatattgttccttaagctccacattactctgtaacacaggtgctgtttaacagctgagaaaagtgaggctgagaagcttccccagaagtcacacttagtgtgtgctgagcagggatttaactgagctgggcagagcccactcctctttcttagcatcatccttcgtgcttcccagtaggaatagctaccattttctagatatctaggtctctctgtcagtgctccttccctttaggccctctcattattgagagtcaaccagactggcctcaaattcatgctttgctacttaatagctgtgtgactttggacagatttcttaacctctctgagtctcaatttcctcatctataaaatgggggtgcctcccacctcctaggagtattgtgagcattaaataatatttgtagagaataatgcctggccagaagtaggtgcttaggaactcatatttttagaaaaagacaatctagcccacaaatacgtgtacagtcctcaaaactaggcactgttgaattttataacttggcatgttgtcttttggttctggggagcttatttaccagattgagttactggcgcaggagttcctggggtggctgagtacatgtgtatgaatatagaataacatcatcatataccaccttcataattagtgtttgtgagatgtcatctctacgtactttttaaataagaaattacttattttgctgaagacaggatctctcatttctaccataaagggcgtgtgtctacatgtgtagacaaaaacaagcaaacaaacagtgattggtaactgatatactctttgcagaagatgagaaatgaagaggacatatacatgtttctagtataatttttgttggaaaagaatccttgccctagttttacactggcagtgttgtaatgtactctatcttatcacccccattaggaaaggtagcctgattgaggtttccaggtgtgtgtgcagaggccctccatagtggaaggtggagaacaataaataggagcatgtgcattagaatagccaacgcagaatagctggatttgttgagctcctattgtgtgctggatacagttaagcagtgcctatatctcatttaattctcactctatgataggttctactcttatctccattttatagaagaggaagcttagagcaggtcctgcggaactttcctgttttttttgttgttgtcgttgttgtttttttagacagagtcttattctgatgcccagggtggagtgcaatggtgcaactttggctcacggcaacctccacctcccaggttcaagcaattctcgtgcctcagcctctcgagtagctggtactatgtttatgccaccacacctggctaatttttatatttttagtagagacggggttttgccatgttagccaggctggtctcaaactcctgacctcaggtgatctgcccacctcggcctcccaaagtgctgggattacaggcgtgagtcactgtgcgcggctagaactcctgttgtaccttcttctgataaccgtgtgtagaggattttgtggcagaatggtgatgattacatgccaagttttggagtcgggggtcaggggagggatccattctcattattattatttgaccttgatgtcaaagtactatgcactttgtattgtttgggcttcgcccaattctacatttggtggggaaaatggcccttctcttagctgtgcaattgtgatttaagaaaatcatttaggaatcatttgaattgtttagtaataatcttacatgtctgcatttttctggaaaatgtaattcagttagctgttttaaaaggaaacctatgggaatttagtgggcatattttataaaaatctattaacggcgtagatttgtatatagtcttaaagtagttccctatttctccacttctttcttttcaaggactttttggcatctgtatacaatttttttttttttttgagactaagttttgctcttgttgcccaggctagagtgcagtggcgtgatcttggctcactgcaacctccacctcctgggttcaagagattctcctgcctcagcctcccaagtagctgggattacggtgcacgccaccacgcctaatttttgtatttttagtagagacggggttttgtcatgttggccgggctggtctcgaactcctgacctcaagtgatccacccgcctcagcctcccaaagtgctgggattacaggcatgagccactgcgcccggcctgtatacattttttaattgtctataccttttggatgtctataccttcatcctagtagtcagtagttattgaacttaattcctagttctagacttgcctcattcaaaagtatgaatcatgacatctttgaaaggggcacgttgcaaggaatgaattgggtgataatagtgacttattatcaccatttaagagaaaatttaagccagttcagaaaattatagcaggtaggaaatggattagatcattcattgtcagagcgtggtccctagactagcagcatcagcatcatctgggaatttattagaaatacaaattctcaggccccaccccagacctactaactcagaaattctaggggtagagcccagcaatcagtttttaataagccctctaatggattctgatgcacacgaaagcttgagaatcattggattagaaccctcccccacccaaaaaaatgctcggaagagttattaagctattgcaagaaatggcatcttcctgagagacaaatttaagttgaaaccacctggttctgctcttgtcagagatagaaaatggaataaatggccactgataggtctttgtaaccatatgattcccctgaggttagttcctgcctaggtatttgtttccaaaataagtatcccaaataaataccagaacttcatgtaatagtcgaagaaatagaattcagtagtcaaaagggattaaaagcaatttgtacatttactggagactagaaaagtgtcaaaagatgaattcctaatatgcagctttttgcctcgtcctctggctcccagtattatttgtgcacacacacactgacacacccacacactgtaccttccaagagtcacacaaaacccttccctcactcaattcctagtcagaactctccccagaaacagtccaacatggctcatggcttcctagtccctcatctctctttcacttccttctctcttttattccccccatcccccacccccatgcagcatatttttcccctttccagtgtcgattaatgaaaactgattcatttctcacagtcctggaaatctacccacatacattctccatctgtgtaatgaaagcccaataactgattcatattggatgggtagaatggaaaaagccaagaacataaagacagagttctctttctggtggagagagagatggagcagtctcatctctggttgaatggggcctcagagctgttccacctgaaatttcatgatttgggattttgaaagtgccaatcatacattaaattgactttttagggttttctttttttgcacattgtatgctggtatgattaaaccttcattttaacactgtttttgtttgtttgtttgtttgttttgagatggagtctcattctgtcacccaggctagagtgcagtggcacgatcttggctcactgtaacctccacctcccaggttcaagtgattctcctgcctcagcctcctgagtagcagggactacaggcacacaccaccacacccagctaattttttgtatttttttgtagtgacggggtttcaccatgttggccaggcttgtcttgaactcctgacctcaggtgattcacctgtctcagcctcccaaagtgccgggattacaggagtaaaccaccgcgcctggcctcattttaacactgttaagggttgttttgttgatgttctcagagtgcctttaatggttatgaatttcattttgaagaaaaattaggttgctacacaatttcgctgttggttttcatcaaaagtccattgtattaaagcactcatcctgagttatggagagaattgagatttagccctacactgaaagaaatttaaatgggaagtttagtgaccttatgggattgtaattggttttgaggttttaaatgaaaaatatgaggcgggagtatgtgatgctttccgaacaaaaacaatataccctcatgcaataatgaaaaaggttctagattctgtcagttgattttcagtttccacttgcaagattgaaaagttcaattggatttcaggctttattattttctagcatatttttgcataaatcattacccttgcctggaatttccaactcctgcctttcactgatctgaatctgaccccacctcctctctcccaggagagcagcagagtccagaagaaatcacactggattaaaagtcagagagataattagactcctcccacttaataggacattggatgggtgggtcacttgatgttttaaagtctccatttctttcttttttttttttttttgagacggagtttcactctcgttgcccaggctggagtgcaatggcgcagtcatggctcaccgcagcctccgcctcccagattcaagtgattctcctgcctcagcctcccaagtagctgggattacaggcatgtgccaccatgcccggctaatttttctatttttagtagatggggtttctccatgttggtcaggttggtctcgaactccagacctcaggtgatccgcccgcctcggcctctcaaagtgctgggattacaggcgtgagccaccgcgcccggccggtgggttattttctagattaaagaaatgggccgggtgcagtggctcacgcctgtaatcccagcactttaggaggctgaggcaggcggatcacgaggtcaggagatcgagactatcctggctaacacggtgaaaccccatctctactaaaacaaaaaattagccaggcgtggtggcgggcatctgtagtcccagctactcaggaggctgaggcaggagaatggtgtgaacctgggaggtggagcttgcagtaagccaagattgtgccactgcactccagcctgggtgacagagcgagactccatctcaaaaaaaaaaaaaaagaaaagaaaagaacccctctaaaaataatggccagcaacatttaatgagcatttattatacgggaagttcttcccacacatttcatgtaaccatcacagcagctgtttatcacaacacatttatcatttattggcagtttttttcatccccttttaaaaataaacactcatttttcttccaacttgctaacatttatttttgctccccagttttacaaagtataattaataacaaagctgttgggattgtgtgacaaagatactttatagaaatatatatgatttttacatactcacatgtaccacataggtttgcctttggaaccagatatatcatctagatatttgggatgaaaaggaaaaacaggcaacctagaagatttgggagaaggccgcagataagatcaactaggctctggattttaagccttgttgtggaacactccctgatgtggtttttggtattttgctttttttggggtgggggggagcactacaaattcttttattgcaatataatttactaataataacattaatcattttgaagtgtaatctggtggcattttgtacattcgcaatgttgtgaaactgtcaccactgcctaaaataccatcacattttcatcactcccaaaagaaatcttgaacccattagtagtgtttcacaatgtctcccatccccttcattccttttttatggctgaacattatttcattgtatggatgtataacgccatattatatttatccagtgtgatggttaatttttagtgtcaacttgactggattggggaatacctagagagctggtaaagcattatttttgtgtgtgtctgtgagagtgttttcagaggaaattggtgtgtgagtctgagtggactaggtgggggaagatccaccctcaacgtgggtgggatcctccaatcccctggaggccaagacagaacaaaaactgaggtgctcagtatatgttactgcttccccttcatgaacttgacatttcttgagtgcttactgtgcacaaaacactgtgctaggccctttgggggctacaagaagaaatggaacatagccctgcccttaagaagcttgtatcctgatggatggactggaaagggagggttggcgagagagggcatcgggagggtagagtttcctgtgcctgagggtggtgaatgagagagggaaggacccgaatgtgaagtaaagaggaaaaaggtctgtgagaatcagagcactgatggaattcaatggaaagattaatctgtgtgtgtgttgggggtggggctatggggagcagctcatggagtgccttcctttctttacccttgtattcctcccacaactctagcagaaaaatgggtacaaagatgccttaaaatgttggttgtttttatagacacttctggtatgaggttaaaatattctgcaaattgggaggtttccatcaatgggacataatattcgtggccctttgattcagcaactttttgagtccctcccagtctttagggtgccagagattcagagataagacaagagtttagaggacaagggtcaaatgaaaagacccaaagcctggcagggtggtgcacacctgtaatcacagcgactggagaggctgaggcaggaggattgcttgaggccaggagttaaagatcaaccaggggcagcatagtaagacccagtccccctgcccctgccttccacctccacggaaaacaaaacaaaacaaaacaaaacaaacagacctagacagtagcatgtaggacagtaacaaccttggcaaaggtaaacactgtggaggaatgtggcaggtgatcagtcattccttctgcagactgttttggggctcactctgctgagctctgtcatacagagagtagccacagggagggccctgccctgtagaatcaccataatctagaacactggttctcaaggtgtgggccctggaccagtagtgtcagcctcacctggaagcttgttagaaaggcagattctctggctcaccccagacttactccatcagaagttctggaggtgatgtccagcagtcattttcacaagccctccaggtggttctgatgcatgctcaagtgtggtgagcagtgggctaggacagttgtcaggtctggatgcacattagaatcacacgcggggcttttaaagcaacagtgcctaaaccacacctaagactgactagatcagaatctgaagggagacccaggcatctatatttttgaaagctctccaggtgattccattgtatagccaaagttgagaagcggtggtctccacatgcttaaacagatcatcacagtgcaaccaagagtgaccattaaggtgggaaacagtgcctgtgagtccacagagcagaggatgcctggcaaccccttgaagggatcaggatggctccccagaggaggtgaggacccttcattgtatttcctattggatgagctcttcattcctccttccctttttttctggacattgcagttgcacaaatctgagtgtgatcggaaaggttattttaaaattcatttaatgtgattaatttttcaaagttgaacacagctggcttccctttaaaactttgtattttgatagtggttcttaccatgaataattgactaatatcaggtcattaatattctataggagagtacttcaagctaataaaattcattttaaaattagtttttaaaaatgtgttcctgcagcccagggatagtaggatctcagtcaagtatgagattttatgcttttctgttaacataagatagttgtttgactgctcagtatccctgttttattccaatttttttgtaggaattaattgcccaggaaaagacctctgtttcagagttgcaagtttgcctggatgctgttgccctgggaaacattattgcatcaacagtggggaaggggtggctctgacatgggtgctctttgtccttctcctgggtagggcatctctgagagggtatcccctttaggtccttcccagggcttcacatttgggccagatttttttaaaaaataattaaacttttgtattttgaggtcattgtcaatccacacgcagctataagaaatattataggctgggtgcagtggctaatgcctgtaatcccaacattttgggaggctgaggcaggaggaccacttgaggccaggagttcaagatcagcctgggcaacatagtgagactgcatctctacaaataaataaataaataaataaataaataaataaataaataagaaaaaaattgccgaggccaggcgcggtggctcatgcctttaatcccagcactttgggaggccgaggtgggcagattacgaggtcaggagtttgagactagcttgaccaacatggtgaaaccccgtctctactaaaaatacaaaagttaaccaggcgtggtggcgcatgcctataatcccagctcctcaggaggctgaggcaggacaatcgcttgagcccgggaggcggaggttgcagtgagccaagatcgcaccactgcactccagcctgggcaacagagcgagactccgtctcaaaaagaaaaaagagaaagaaaagaaaaagccaagcatggtgacacatgcctgtagtcccagctacatgggaggctgaggtgagaggattgcttgggcccaggagttcgaggctgcagtgagctgattgtgccactgcactccagcctgggtgacagagtgaaaccctgtctcaaaaaaaaaaaaaaaaaaattacagagagagcccatgtaccctttacctggtttcccccagtggtagtatcctacaaaactatagaacagtatcacaactaaaatgttaccactgatacaatcaagacagagtacatttcatgatgccttttatagacatccacttccctcccacccctaccctctcaacccctggcaagcatgtaggcatggatctgttctccataagttcttatggagttcaaaggtaaaactgggtccctggttttaaaaaaagaaagagatggccatagactgtggctcatgcctgtaatctcagcactttaggaggctgaggcaggaagattgctttagcctaggagttccaacatcagcctgggcaacatagggagaccttgtctctactgaaaaataaaaaaattagccaggcatggtggcacatacctgtggttccagctacgtgggaggctgaggtgggaggatcacttaagcccaagagttggaggctgcagtgagcaatgatcgtgccactgtactccagtttgggcaaccaacagagtgatatcctgtctcaaaaagataaaaaaaagatgataaatgcacacaaatagggcacatggacaaaggatgattgggtaggaaagttagacattttaggatttcaggccatacataaagactttcttttggaactgaattcagcactgtattagtctattttcacactgctgataaagacatatccaagactgggaagaaaaggaggtttaattggacttagagttccaaatggctggggaggcctcagaatcatggagggaggcgaaaggcatttcttacatggcagcggcaagagaaaatgaggaagatgcaaacgcagaaataaaatcatcagatctcgtgagacttattcactaccatgagaacagtatggggaatactgcccccatgattgaaattatctcccaccagttccctcccacaacacctgggaattatgggagtacaattcaagatgagatttgggtggggacacagagccaaaccatatcaagcattacttcttggatacactgtgtctttagagggcatctcctggtgttagtgttcacagtaatctacctcaattcctctggtttaaatctggctgtgttttggtaataactggtttatttgttagaggccatggtttgtgctccagccctccttacctcggaatgagctcaagggctttttgacagcctttgggagaaacatgtagagtcagaaggtggaagctggagatgagttaatttggcttctcttggaatggatattctcaaaatgtttgctcaacaattaagcagaagaagcagatgctgtgtggaagaagctttactcatccagtaaatctcaatcccgactgaactcagacttccttatccacatgtgccccagagcagctagacgtgcagagagagaatcacaggagggagctgccaggcttctcactgcagggtggtaaccgccagccacatgtggctattaagcgcctaaagtgtgcccagtgtgactaaagaactgaactgtaactgtacttaattttgatatgaaatttaaatagccatgtatagctcatggctaccaaatgaacacagagattccacattgcccatgttgggctgtttgagtcactccacccctttcagtgggataaaactgaatttaaaaaagaaagagacggccatgcattgtggcatgagcaaggagaggccttacagcttcccccagggtcctctgtaaccccttccccacccagcatcagccctaaaacattgctgagcaaacattttcaaaccactagtgtgaggaggaagctgctaattagcctgcctggacaggagccacatctgtgtccagctgggccagcgcttggctcacagtactgcttacttcatactgctctaatgagtcacacttgacttctctttagatttgcaagctcattcttggggccaggttaagatttgttccctgcatgcatcacttcgttacagcactaagactaaggtgttacatttcttcccgtgccagggaagcagcacagaaaagcggtaactgagaatgtgggtcctttccgccagatgtgagagattaggaaaaaaaaatttaatggtttttaaagtgggtcctgaagccagtttcttgcattggaatctggcttcaagtgcctctgtttctacacctgtaagacaaggatcatcacagcacctctgtcatcatagggtggttgggctgagaaagtctgagcagtgcactttgtccttgggaactgctcagttattacctcttattatgatgatgctggtgatgatgactgtgagcatgataataaagattttctggaaagatgatttgaaggtgtgactctcatgtgtgtccatgagagggcagcctaaaatcatgcatgtctgtggaacaagcagcctctgtaaagcctcaaggtaatgtgggcagtttcaagtgtgtttggccctttttcttctctgtttttcttttttccctctgtttgaagagcgctttcagccattttcaggcttactttagatacggagcaggcccatgaacacctagagggcagcatgggcagtacagagctaggttcaggccctgcctgggtgggtgagtttgtgtaggtgccaatgagagcgtctgtctaggcgtcctaggcttttctttgtaacttttcacacagaactaattcttattaatcagactcttgaggtagacactagaacctgactgtgtttagagaaaaaagaaacttgattttctatgcttgttccccttccactaacttcacacctgcctctgagcattgtgtgcatgcattggtgccaccatgtaaggggacagtggccggagctgtatagacccagagttgcatcagccacacatggctctggaacacaccaggggagactgagttacagagagagcagaataagagtcctcaaaccatgtgggagcacagagcatcatagggctgggggacagtgggggtcttgaagatgggcagggtttaaacagatggagcagggtagaataaaggatggcatgagctagaaggtgcatgggagaaagggcagtgctgaggtaaagttgggaaaagagtttggagtcagattgcggggtggctggaatgagctgaggagttggcctttaaatttttgatgacgttcatattgttgatagtgtcataatgattaagagatgaccaaaaacaaaatgaagaatggcacttggatttttctagtacttatctcattttaatatccctgatatttaatctaggctgcaaaaccagatgtatgtggggaatcatgacaatccagtgtttgtcacgccatcccccttcctcattcccactgcctacactgtgggccaggccttcaggcctccctcctggacagcagcaggaacctccttagaagaagcacaggttgctgtggcagcaaggcacactatgatgccaacttgtgatgctcccagagaggaaggcacagatgctggggaagtgaacctggttatattaacatgaaagctgacttctaaagaatggtgtgcttctttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcaccactgcagtccgcagtccggcctgggcgacagagcgagactccgtctcaaaaaaaaaaaaaaaagaatggtgtgcttaaatattatatacataatatactgggtccagttgtaacagagtgcagtaaattatttgtaatcctaaaatgatcatgaagatccatttaatcttttgtttagaaagccctttagggttctgcaggggttggttggagatgaaaagctccagggatatttctcagacattttcggggaagttgtcatttgttccatcttatttgttgtagatatttggatgattctaagatactaagattgacattggcacaaacttggcagaaccaaaattgaacttgagtgttgtctttcatagtgctcacccaaggagctcatacgttggctcctttcagaaagtaggccgggcatggtggctcacacctgtaatcccagcactttgggaggccaaggtgggcgaatcatctgaggtcaggagtttgagactagcctggccaacatgatgaaaccccatctctactaaaaatacaaaaattagccatgcgtggttgcacgcacctgtaatcccagctactcgagaggctgaggcaggagaatcgcttgaacctgggaggcagaggttgcagtgagccaaggtcgcgccaccgcattccagcccaggcgacagagtgagactctgtctcaaaaaaaaaaaaaaaaaaaagtaaaatgttcagtgtctgtgtaatgagcagtattcaaaattttgtccatttttgtgcttctcctctcccccaggtggtcctgcttcaggcttgggagcctgactagacgaggcctagtgggcttctctgcacactgccaggcccgtctgtcacttactgtactttctgaccccttgtctgcctgggggcaaaggattaaggaaggggctttgtcctctggggctgatgttggcccaactacaggacagcttggcaggtgcatgcgaaagtggtagctgctgcccctcagctgtgtgtgtcatggagagtgacagattggacttcctttggttgaagtgatggagatggatgatgtgcacgtgcagtcagactcgggtgccatgcccagttgcctatagtacttagcagatagggaaagagtgaagaactgaaacataatctagttttctcctttgtaggcatggagggatttttgaaatcagatgagaggcagagattggccaaagaaagacgagaagaaagagaaaaatgtctgggtaagttatgcactttggctattttggtccaagggagtggagatatggtggtgtcttttctgaagattcttagaaatttgtgaatgaatgggaactaggacagttgctagatgaacatgaagaatcaggcgtgaacctacactgcaactggcatgttcacaaataggtaattttcagaatagttcactcggcaaacattgaacctctgctgtgttctagccactgtgttagggtctgcagttacgatattgaagaaagagaaacagtcgctgcccctgatctaaggaagtcctaacaccttcaagtgtcaactgtgtacactccctcaggttctctcttgggaatctaaaagggccatcctcaggagaactgagaaaatcagcacttgagtcattttatattttaggacagagagccctggttgagaaaggccgtcttgcctcttgcaggctgtagacagattagtgcagagtgttcttcacaggatgctgagggagatagcgtttccccattgcattgagacaaatgaggagctttcaggttcttctcttcttcactgcctcctgctggtcggtacaagcattgcctcctccagggaacccttccctgccttggctaggtggaattaagggccccttagtaaatgccttgagggtaaggcaaattttgttcgtgtgttttaccccctgacttagctcagtgtctggtgcttggtgcacacacagttaaactgcttttgaatgaacatagccttataagcatcattgctcaacctagcatatagtttagccattatgcacaagtttgacttaatgacagccgtcatagtcatagctcccacgtggggaggcacttactgtgaacttcacggtcatcatcttgttcaatcttaacaacactgtgatgtggcaaacatgactgtccccacatcgtagaggaggaaaccgaggcagagagatgatctagctaacatgcttagggttacccagctagtggcagaggtaccagaaccctttatctcaatcactgcatgctaggatcctaccaggctctttttagggctctgctcttgcttccttgtttttggtcttaatccaaactgcatgggatgctctggtaatgacacctctcttctactttccttccccagctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggtaaggcccaggtgcaccctccgccaccttccagccccctcagcaggctgctcagagtgcctgggcatcctgcccagctctggggtaggagagagacctgccgtgcaccttctccttggtggctcccatgccttctttcagcaacatgacatgaaactcgaagcagcactgacatagaaccgcagagacttatccattcaactcaggtgttaatttgctgtgtgatcttgggcaaactggttggcttctctgggccttgatttgtgtgtctgtgaagtgagggttggatttggcagtctccaatgcctcttttagtcataaccttttctgactctaagactcaaagggtccctggtggtctagtagataggggaaaaaaaaaaagactcagaggagattgtgggtagcggctgggtgaggtgaatctgaggattacagatgggagttcatgcctccagggcaggcacaaggccagaacaagagcttgtgaggttgagaacaatgtgatcctgtcagttgctactggcaaattagtctaccctcaaataccaagatgctaatatatttaaagtttaatgtagttcttcgctttaattgctctttccagttaccttttaaaaaagaaatggcacataattacccctacagagttctttattactaaattttgaaaatatatttagaaagcatatttggattatagattttcttcacgattatatttttaggaggtaataaaaaccttatgtcagttgatgataattttttattcataaggtataatgattcatcttttagtatgaacaatatagaggtttggtaatctccaaccctataggatatgaagatgtttgtacaaattcagtattttttaaaatctctgaacagttgcttatcactatatatatttaccccttccttcttttttttttaaagaacacatacgaaaacacacacatagtcagacccatctttgcccaagaagcaccctttcatggtgatttctttcctcctcttagaaaatgaggtctaagccagtgtcttagctatggttcaccgttattggctgcagtctgattgctgtgccttcatctgctcccagttcaaatgtcagctccaatgccagctctaccactgagcagctggtggccaggggcaagtcacatgcccctctaactctgtctccttagcccaaaacagaggtagttacaggaattaaaagaggtgacttttgtaaaagtgcccagcaaagcacctagcacagagtaatcgttcaggaatgttacattctgtttagttacttcagctgagcttggctaaagcaaggtcaagagggtgctacccacaaaagcttatgaaacagagtcagtagatgggaaaaagccacagtataataggctgttttggtaacttgggacagatttctcctttcctaacttctgtgttaagagttgctggactcacccattttcttcccatcctccattccttgatgacttagagcttgtcctcttcttccatgatctctccattttgaaagcttgtcactgctgcttccaggaaggggtactgtgaagtcacataagacacttcccatgctctgacatatgcattgtcactgggggctgcttttgaggcaatttctgtttataatttttctctacagaacattagtgctggaggcatgttaaattaagtagaacagctcccccttcttggaggtgagggagttttatgccatatggttggtcctgatgcagctgaatcttttgtggtttcccttctgggtaattttctatttgtgtgcttccttgcacccctaatgtggtggagggaagcaggaggctgcccgaccgacccttgtcagcccaagctgagcttggttccctcttctccctgggcacagcagggcagggctgagggctgggcctcctgtggttgtgtagcaacccaaggaaacagcagcctccttctgccacctgctcctgccctcagggtcccaggggacccaggtgtagcttagggacttgccacacacaggctggcttgttagctacattgggtcggtgctctgctggcacagaggcctttttggcattctcgtgggtgacatttagggagaagggatcagcctgcattacggaagcccctcttcaaaggaaaccctctgcactggcccctatgattcaaggggagctctgggagggctgcagcctgctcagtgcctggctgtggatgttctccattctcttctcagtgtcagattgaagtctttttttttttttttttttttttggtcatgttctgtctctgtcagccagagaaaagcctctgcaggaagatcattcatcctatgcaggccattttacttctctagcctgttggaaagtgtttgttgcccaccaaatcctgcctctctgggtctgatacttaggagctcatgagaggcctgttgaccccaccccagccctgccctggctctgtacccctatggttgccatgatgtcactcttgataacccctcatgtctgtgccagggcagaagtgggtaccaccaatggcctgtctctcagaggtcttaagagttggcagaggtcttaagagtagtcaggcctgtcccagggaggggtcccagggaggggtggggtggttctactgtccacttgacaccctgaccttaaactcattctcttgctggaggccacctactccttaagttcttagaaccttcacgtgccacacagctcccaggaaccaagctaccagaacaagttcctgtcacctgtgttagggctgacaacacagtatgccagcccattctcagggcagtatagcttcctgaccagtggccctggaaaattggatttggaaaagccaacttcatgttccttatgctaaacagaaaagagaaaggcctctttctctttctttctttctttctttctttctttctttctttctttctttctttctttctttctctctctctctctctcttttcttttcttttcttttctttcttttctgcacacatccctgctgaggaccgctgggggtgtgtccctgcagtgtcatccccagaacacatgtaatgggccgggcatggtggcttatgcctgtaatcccagcactttggggagccaaggcaggtggatcacctgaggtcaggagttcaagaccagcctggccaacatggtgaaaacccatctctactaaaaatacaaaaattagacagacttggtggtgctcacctgtaatcccagttacttaggaggctgaggtgagagaatcacttgaacctaggaggtggaggttgcagtgagcagagatcgcaccactgcactccagcctaggtgacaaagcaagactctgtctcaaaaaaaaaaaaaagaacacatataatggcagttgaaaaggcacagccaccccctaccacccattcctgccagagactgctgtctgagtaacagtgtctggaatgtgccctgctggcaacctttaatactgttcagccagttcagcggggtcaccttggtcgtgattctccaagttcatccagacagatctaaagccagacctcaaggcatcaagtgtgaggctcgctccttccttctttccttccttatctccctttccttcctttctatctttccttccttcctctctttccttccttctttttttccttccttctttccttccttccttcctatctatcctttcttccttcctgtctttcttccttcctatctttccttccttccttccttccttccttccttccacccttccttccttccttccttccttccttccttccttccacccttccactaagccctacctaatagaggagattctagggacgaggatttgccttgccctttccccatcctctgttgatcatcagatgatactcaggagaaccagaacttggcaggaattgcagtatgcagttctgatatttattaatactgtttttctaatgtgatggaactttctcatgctcactttctgttgctcagcctttcctctaaccagtggctcttgcttgggggtcccatgaccagcagcacctgggaacttgttagaaatgcagattctcagcaggctccaccccagacctattgactcagaaactctggggataaaccccaggattttaataattcctccaggggattctcctacctgatctctcagatttgagaactattgctctaaatggtcctgataagaatcttcctctttaaattcagattcacttagctttggttaaggacttactgcatactagtcattatcaaatagacttagagtgatctggtgatgtaggtaagctcatccccattttataggcaaggaaactgaagcccaggactgcaatgttagctcaaggtcacagggataaaaagtgtcaggcagaggtgggatttgaatccttacctcctgattccaaatctgagatcctttctgtttcgtcatatgaaggaacaaaaaggtacacacaaacacgaggcaatactgacctattcaggactaaccttaaataagacttgtgcactggacaagttttgttttctatatgtatgaatcaccccattctgactttttggggttccataaatcctcttctcttagaacttgcttatcatctatttctcatcatctctccaaaagtgggtgatacaaagtgagtgtgtctttctctcagggacaactgtgttttcatcggcctcctcaaggtctgaaggaatgaatctccagtggtgggatttggagcagctcagtggactggggatggatggcaggggtagtttttctagaggccattgaaaagtccaggggcaggtctggctttcagtgagcactcattcccttacaagggtgccccccagatagctgatcagtggtcaggctggttcagtgaagctcactattctttcttttcattggtcccctagtagagaagggaccactttgtgaggtccttctggcatgtaggaaatctaccgtaacccacccaatacttaattcactctaggatgaaaggtttcaacacttcagttaggtcattggttaaatactttacgttaaaccgtataatgaaatactattcagccccaatctcgagtggctgtacttcaggcatcacatggcagagaagttctcttccttccaagccccagcttttatcaggcagactgccagagttggccatcatcgtttaatgggccagggtcgtgaggactggactctgccaaggcatgcatactcacgattgtagagtctcaggccaaatacaagagcacagttaatagctaatacaaatctaagagttacaggaggtaaaaatccccctttctgcttacaggtccctggagaggcagtctcttagcaaagtgctattcagagaaaaattatgtagaggaggctgagatgtggagaagccagatcctcatctcatccctctggtatagacagaagggataaatccagatacctattaagtgacctttatatgtttctagtaagtgtgacataaaggagcctttcctgatctttaagtcatggttactcagttgatgatgtcctaaattaattttgcttctgtgtgtatttttttaagccatgacaattgtatctttttgttttagaatgggctatgattagcccagttcctggagcacctcggggttgggttttatgagggcaaaagggtgtcattataactgctagctcaggccttctccagtggagatagggagaggagttggtatttgcagtgtcacggaggtggtggggagtgcagaattagagcaccttcactgcagcagcaaggacaactttatgaaagtaacaatttgggtaatacaggagagtgtttttgataaatactgttacgagagaagccgaagcctaatggttgtttttctcttctggttaaaaattactgggttctgcctccctgcctcctccacctaagtaactctgggaacgcatggatgcttttttttttgtggccagaaggttctttactcttgcctcttgaaaattttgaaatatgcaatattatcccagattactatatagcagaaaagcgtcacactatgtaaaacagttggttcccctttaagaagttctaagatgaaaatgcagctttgcaaaatagatctcagtgtcatgtatcaccccaaaaactcaaattatatttgcattaaaattttctcaaagcaaaatgttttatgcttttaactagaaaggatgctcttggttctggagcagaattccagctctcctggttagggcaaaatgccttgagataggcctcaaggagttaatgcttattgggcattattcctagggcagcttctccccagggaggggaggggacaggacacacggtgtttaggttgagagccagtgctagcctagccgcattgtttactctccacctactcagaacacgctggtgtggcagagagagcacgtatgcctgggttttggatgctgagcacagaaagccccatttggtgactcacactgtgcactgaggcagcaggtagtgtggtggggctgggtagttaatcttgttaacacttgccttacacgaactgtgtaggaacggctggaggcgatgatgcgccggtccctggagcgcacacagcagctggagctgaaaaagaagtattcgtggggagcaccactggccattggacccggaggacatgatggtgagtgtagggttgcccctgtatttcaggtcctgggtgggaaataatggagcaggcaggggattatgggcaccactgggtgtctccaggatctgggggatgctttgcacagcttttcagaggcaccactttcagatgtgatgtttaaaactgccaagattcctacgcatgcatttgttatgaaggggatctgtgcattcttcttgatagcaaacagcagttgacacaaaaactgggttttgagggagagcaaaagagaagactttgaacgcagagcccagtgagctgggcccagctggcaagcccagggttgttctgacttcaggggagggaaacggcaggaggctctgtcactggtccagatgcgatcaggaaaagcacagtggcagttatcctccaaaaagggctggactatttcctgctgcattttaaatttttgttgctttttcgactttgtttcaaggtgacttatttcattaccagttcaaactcatctttaaattttcaaatgtgtaatttaatatatggattgttactagtctctggatggcttttccttcttttcagtgtctcactacatttcagcgatcttagcattctattatgcaggaggtgtgtactagctctatctgagagcaaatggatttgtgtttacaggacagttcttgactttgctgtattgtgcttttcacctttgggcagtaaatatactttattttttcttttttgaaaagtcaacaacccatttcagttactttttctaatttcctaattagaaactaagaagcaacaagaaattgggacttttttcttttacctctctttgctctgattttttgctgtgtaggtgaatcagaaaataccccaccccctcctctaggtttagcagccagcaccctccctccggatgcagggaccactgccgcagctgccgagtccaccaacggtatatccgagcatcactgtgccatagcattttgtgataactgttctgatcatcctcccccatcaccatgtctgcgtcaagcacttttacaattggtttcttagtctggcctgtcacaatttttttttcctagcaatgtgaatgacatgcccatatttctttgttcctctgtcattatagagcggtgcatgccttacatcttagtgccccggagacatttcatcctcaactcactaacgtctgccttgaaaatcttgtcagtgttggatttttgcacactcagatctttaacaatctcttcatcatctgttgtagacattaagaagcagggcatttctgattacttctggttaccaaaacctgtaatcacccggagttctgaatggagaacttgggcttagtgttaaagtgatagattcctggagaggtgtttgagagggagtggtaggaattttatcagtgctaacactggtaatccaaataattagataatttggctttgtgcttgattttatttaataggctgtctgttttgtatacaggcctgggaaactcctctggtctagatcaagaacagaactagccaaactttgtttccatttaataatgactttagaaattcaatccatcttcaactggcaaagaaaaaaaaaaaaagctgtaaaagggatgcaatatttaccaacaatgcggaaggtcatattagcagtaggaatcaatatccttggtttctgacattcctttgacaatgaataatccttactgggggtgcttcgtaacagcagttttgctgcacaagcagagttacctctagtgtgggcactggctttccccctaagaaaggtgcaggggggctgggcgtggtggcttgtgcctgtaatcccagcactttgggaggctgaggcaggcggattgcttgatgtcagtagttcgagaccagcctggccaacatggtaaaaccccgcctctactaaaaatacaaaaattagtcaagtgtggtggcgggtgcctggagccccagctactcaggaggctgaggcaagagaattgcttgaacccgggaggcagaggttgcagtgagatcgtaccagtgccctccagcctgggcaacggagcaagactctgtcttgaaaaaaaaagaaaaaagaaaggtgcagagaggtggagtaatcacccactgggaatcagcacccagggcccgggccagggtgaaatgagtgcagtacttgactagagcatacaatttaagggagtgccaaaaatctcagtaataaagataaaataatatcttaatgtgatattttttaaaatccaaattaatgcaaaacaatccataataaacaacaaatttctaaagactggtgccatgctgagcacatcagagcctgaagcaaaagggaaaatgtgtactcctatatacgtggttttatgtaatttctaatgtttagttttatcaaaacattaaagtagtttaaaatatggaaaaattgaaaagagtattaaaactcatataatttcaactttaaatagttttatttctacacaaatcaaatttattgtacttttacttcagctttagttaattaaaaattaccgggccaggtgcagtggctcacgcctgtaatcccagcactttgggaggctgaggcagatcacgaggtcaagagatcgagaccatcctggccaacatggtgaaacactgtctctactaaaaatacaaaaattagctgggcgtggtggcatgcacctgtagtcccagctactcaggaggttgaggcaggagaatcacttgaacccgggaggcggaggttgcagtgagccgagatcgtgccactgcactctagcctgggagacagagcaagactctgtctcaaaaaaaaaattatttaagattgtcatttggtcagcagaaattatagaacatcgcagttcttatggcagttctcatgggaaaacacgatgagcagaggagtagattttgaaaatattattgatgagtttgcttttttacaaccaagagcacacatttttcttttggcctcaggctctaacttagcttggcagggcactgtcagcatctctttgtttgccgtctgaaataatgactggaacgtaagaacaccaaactcagggtcgcctgttaaaatgctaacctcaaacagttaaagcatttgcaaaaggaccattttgatctgtctcttactaagtaagaaaaggaaaaccaactgctaaagaggccgttctgctttaaatacaactctgagaggacggatttcatctctctccaacctgagctacagataaccttcataaaagagtcggtttcagcaagcggtgacagtcagaccatagggcgttttccagtggtgatttgtctctgggtccaagttggttttgtttttgtgtgatgtgagcatgctcaaaaatccctagacaaaagaaaatgatttgttggtgggattaacacggcttcagttgaacagttgagtgaggttgaacatttgaaattgaagatgacaacacagtgaagaagttgcagagattttgctgcagaccaagggctgctgtagcctggtcatttctagagtaggataatgagatgccaggatgatgaaagcagagcatgctgtgccacagcatttaggaggtgcgtggatgaggacaggaaggacacttcgggatatgtgtttcttggttctacagtagtgtgatgaataccaatgtctttaatgcatttctctgcagcatgtgacaaactttcaacatcaactatgagtttgccaaagccaacggagcctcccatgaataaacgcctgtcttcatccaccgtggcaatatcctattccccagaccgaggcaagtgaacatgtagacttggtctctctagtttgtttcttttctggtgtgagcatcttaacgtttgtctttgtgagagtctcctcttgagccttctgcagataccgtcattgtcctagtcttgtggtctgaatgtgggagctctagggccttgtcagtgggactttggaacgtggcacggctctttagagccaggtcgttgttgaatagaggtaggaattaatgcagtctcccagtctgaaagagactgttctgttttccacattgcatgtaggagttatcctgcccaggaattaattaaccagtgggcagatgtgaccattaaagtaactgcctggtcaatgatggaatacagttgattagccagaaagagcagaattgataagttatagttatatgggaggcttagatatgtgaaaaaatggggttctgcagtcatctgtggtttataggcctgcccattttgtagatgaaaagagaagcacagaactaatgaggcctctaaaagaggaaaaggttgggtggcgctctgttttgagttaggagatgatgtgtatgggacgtgtgccagttccagaacctgagtagatttaacagggtctgcattctcacaaaggctcagataagtcactgaaagtctgtttatacctttcagagtatacaggttaaggaaatgacggaagctctccatgcactaaatgtttattctaaagcaacattgaagaagtatcaggtgccagtggagtgtttagcacaagttatcaccaagggcagagcaaaaggctggttgcgacttggcagaggctggtgtgccttcctggttgtttccactgacattgaccttgtacctctatcccagaggcatattatgtgtgtcagagaccctataaggttcataatgctactgatctgtgatgcagttcatggtaagcaccaggaacctggaagtgatgaagagctgaatacagagtgagggaaaagttaattcattgccatatataatacattcaaaactgatctaaatattttggtcattgacttccagattatgaatactactatttgtctttcattaaagctgataatcagttggctgtttgtatttttgtgcctctcacttaatttttacccttattgacatgtaaaaagtatgaaaagatatatttttatactattacaagatgacattttatttaaaaatcagtgtgttatgaaatgcttcttagcgcaggacctaaaacaagtgttttataggcataatttgttttctacttggagtaaaggtttttttgttgttgttttttttgttttttttttgtttgttttttttttgagacaggctctctgttgcacaggctagagtgcagtgatacagtcttggctcactgcaaactctgcctcccgggctcaagccatcctctcacttcagcctcaagtagctgggactacaggcgcatgtcaccatgcccagctaatttttttgtattttttgtagagacgaggtttcgccacgttgcccagggtggtctcaaattcttgagttcaagtgacccgactgccttggcctcccaaagtgctgggataacaagcatgagccaccatgcctggccataaatgatttcctgagtccatattacatctgggaggtgggctaattctctgagtgatacaggttactgtactgcaatagcatattgaatggattttggtacctagtgacaattaatgcactctcccaaactctaaaggacacattatttgttttattttacgatgacaaattccaaatccatcctttgttcaaatatttttattttccatgttctgccacccaaaagttaatttgcaccatgcattgtgttgtttaaatgttttattttgttttgttttaattttgctttttaaaattttcatttgattccatccctcagctcatcacatgcaccttagtccaatggaagccattcttgtttcgcgactgttgacacccacacagtcttctttagccagaagcagagcttcagtcatgctctctgggcaggccaatgattcaggtaaaagaggctaagctggtaacaccaaggaaaatgcccgaagaggtgttggtcagcctaggatttactcctgaatttttggattttgcttcctatttgctggctttgtgaaaagtcttcattggttaataacgtcttataccagtgttttgctgttttatgtttcttttgagtgtcacagaggtgagtaaattatcttatgagtgagagcatgttctttaggggaagaaaaccccacttgatgaactctggaggttagtagacttttcttaagagacggtgtggcaaaacagcctgtagaccagtctggggtgtcccatagccagctctaccactcactagctctcaccattgggggtaagttaattaacttctttaagcctcagttttctcatctataagatggagctattttaaattattttgaagattaaatgagagagtgcatgcaaatgagatagcacaatgattagcacagaatgaaagctagaaactttgagaagtttctagcctcactactcaaaaggtggtccatggaccagcaatggcagcagcatctaggagcttggttggaaggccccacctagcctgcacactgaagtctgagaaacactggaccagaccatcaaagccctgcctttatcaaagcagatcaagtcgtcatgtcaggatttgtggcggctggcattctctttgtttccagatgagcagcactgtgtccacctaaggtcaggtctactctctgttctccagatagtgtactcagttgtgatgatacataaatgagataaaacttctgcctagttgtagctgcttccaaacagttatactgtttctgcaaataagttgtacagatagctaataggttcataagatgctcaacatcattaatcattagggaaatgcaaatcaaaaccatagtgggatgccactttacacccactaggatgactagaatttttttaaaaggggaaataaccacgtgttggtggaggtgtggagacactcttccctcacacactgctggtgggaatgtaaaatgatgcagctactgtagaacacagtctgaccgttgctcaaaaacttaagcatagagttcccatacgacccagcaattccactcctaggtatacagccaaggaaattaaaaacatatgtttgcacaaaaacttattcacaatagccacaaagtggaaagaaaatatgatatacccataaagtagaatattattcagctataaaaagaaatacaggccaggcatggtggctcacacctgtaatctcagcactatgggaggccaaggtgggcagttcacttgaggtagggagttcgagaccagcatggccaacatagtgaaaccccatctctactaaaaatacaaaaattagctgggtgtggtggtgcacacctgtaatcccagctactcgggaggctaagacaggagaatcacttgagcccaggaggtggagactgtagtgagccgagattgcaccactgtactccagcttgggtgacacagcgagactccatctcaaaaaaaaaaaaaaaaaaatacagatacatgccacaagatggatgaaccttgaaaatgtgctaagtgaaagaaaccagttgcaaaaggccacatattgtgtgcttctatttatgtgaaatgtctgaaataggaaaatccatggagatggacaatagatggtggttatcagagactggaggagggaaggaaggggagtgactgcttaacggacgaagtttctttggggaatcttgaaaatgtttttagaagtagactgtggttatggttccacaaccttgcaaatgtagcaaaacctccaaattgtatgtgtatatgtatacgtatacatatacgtatacatatatgtatatatatgtatatgtatttaaagacagggtcttgctcttttaccctggctagaatgcagtgatgtgatcatagctcactgcagcctcgaactccaagccctcctctcacctcagcttcccaagtagctgggactacaggcacacaccaccatgcctggctaattttttgggttctttggagggacaaggtctcactatgttgctcaggctggtctcaaactcttgggctcaagcgcgacccatctactttggcctcccaaagttctaggattacaggtatgagccaccatgcctgtcctgtatactttttaaagggtgaattttatggtatatgaattatgtatcaaaaaaccctagcaagtaggaagtaccccattttgagaataaggaatatgttggggttccctaagagcaactccaggatcagtgatttgctaggaagactcacaggatccccagtgaaaggatgcaagcaaagtcagcaaaggagaaagacacatgggacaaagtcctgggaagaccaggcacaagcttgcagagtcctctctggtggagtcactcaggacgcctttcaccccagcaatgagttacgacaacatgtatgaaatgttgccaaccagggaagctttttagagactcagtgccaacggtttttacagagggctggtcacatgtactccatgcccagcacatacccaaattccaggttcccagaaggaaagcaggtattcaacatacaccatgttgtttgtttatgccctgtgagccactcaacagttaaagggggatcgtcctaaaatgtacgttcccaggtgctggctaaaggctaaccttgtaagcaggccttagtagggacagcagtcaggcttgctatgttaactcatttttgcacagctcacccacttgacccttggccaaggtgtctttacagaaaatttttcagtagggccccacatagcagggggtgagaccatcctgcagtattgatctcagttatgtcctttaggggttctgggacttagcagttaaagcaaatctcattaaccagaaggtctgtcttttttttctctctttcttttctttttctttttcttatttatttatttatttatttattttggagacaaggtcttgctctgttgctcttagccacgctggagtgcagtggcatgatcatggctcactgtggcctcaacctcctaggcttaagtgatcatcccacctaagtctcctgagtagctaggactataggtgtgtgctaccacacttagctaattttttttttttttttttgtagagatagggtcttcctatgttgcccaagttggtctcaaactctgggactcaagcgatcctcccacctcggcctcccaaagtgctgggattacaggcttaagccactgcacctggccttagaaaggtctgtttgaggcagccaggtggcctcctccatcagttgctgtatgaatctttttacctggcctgtggcatcagctcaggcccagaacagctctggccagtaagttgaaactgatctgaatgccttccaggcctgacgccgtgtcatgataatcgtggcacgcacataggaactatgatccccaagggctcatgtggttccctggaaaaaaagagttgaagatgttagggcacactagcagggtatcattggtcagtcagttcccagtgtggcctcccactgtggtgactggtgcctcagggtgctcagtccagtgcaggtaattcagctcagtcccaggttttatggcggctgcctgaggccatcagtcccaaacagttctaccagtgaccctacttcatcttcctggcaagtgcagatggcatctggagctgttctgtggggacatgtaggaactggccccactcctgccggctcatagtcatgctgtcacatgccatctaggctcagccatgggtctgagtccaaggtgctttcagcacaaggagttttccttcaggaaggagagcgcttccaggagcagttatggaaaacagaacacaaatgtccttccgtatccctgtatcatttttaccccaggtgttggattatgttgtttttctccatgtcctattcaataatcaaaactttacattttcttaatcatcccctactctcacccagacctttcaaagaaaggacaaaagcatttcttaaaacccatttttatccaacttaaccagaaagatatattgtgttcaggtattaggctaaaatcctaagttttcgaaacattttaaagtaggtttgtatcacctctgagccctttcatcttgatcattttatccagtgagcagcctagaaaagatcaatccctttccagtgacagctgcatttaacaaattgctttactgacgtgtgtagtgagagaaaggtagaggaaatatagtcaggatctcagtctattacaaactgcagctactccagaaaattaaacacaaagcatcaacagcagtgacactttccccagagggaatggagttcagtctgtcagggatggctgaaagagtcacattgcctgtggtgtgacttggagcttttgtaggaatcatgtgttgggaatataatcagactctgcatcagaaataatagagccaatgagcagcttgattgtggatggtcccatcagagaacaagccctgtcttgtgggcacttgtatgtgacccagtctagcagcatccagaatctttttacagttttgggccccatgaagggcattctatatttgtagtggtccctactcgatttttaaaactccagaagcatgtcttttcctagaaattgcctgtcttttcatatctccccttttcaagaggctccattagacaaaagtcatagcagaaaaatctactacagagacttgttctggttctaatatttggagtttaaattccagcctacccactgctggcaaaaagcaaggaggttgtgtctaactctcacttggaggagaaaacaaaaaccaaaggcatcacttgggctgtgctttttccctcactttagctagcatgctacagtcaaaagcagccagggggatccatcaagccaactctcttggagctgtattggtcatctttaaattccgtaggtcacttttacctctcaaaacagctcagctgctgttttataccatggataacttcatagccacccaggcatcacaagtttgttctccacccttttgtccttttcccaaaatgtgattttaccacgtttcagcaaatcagggtcattccagcaattcccatttctgacactagttgtgccagagttccccaagaccaccccaggtttgatgattggctaggagaacttggaagaatcagcatagttccacgcatggctgtgacttattttttctttcttagctttttttttttttttttttttttttcgagatggggtctttctctgtcacccaggttggagtgtagtggcgcgatcttgactcactgcagcctcaactttccaggctcaagcgatcctcctgcctcagcctccagagtagttgggactacaggagtgtgcccccatgccaagctaatttttgtattttttgaagggctgtggtttcaccatgttgccaaggctggtctcaacctcctaagctcaggtgagccaccatgcccggcccatggctatgatttattatagcaggaggaaacatgaaaaaactagcaaatggaggaggtgcatgggactaagttcagaagtaaccaggtgtggatttccaagagtcttcttccagtggagtcacatgggacgagcttaattcctctaccaacacattgtgacaacatgtatgaaatgttgccaggctgggaagttggctagaaactcagtgcccagggtttttactgggggctagatatgtaggcatcccctcccaggcacatacccagattccacactcccacaagaaaagcagatgcttagcataaaccatactgtttgtataaacagtttagacacccatcagttaatggtgggaaccctcctgaaatctaagttctcagatgccagccaagggccacccttataagcaggcctttccaagcacagcagtcagatctgctatgttaacccttttgtgcacaaggaaatcgatgtttagagaggttaagtaacctgcccaaggtgatccagctattaggtggcagtgctaggtctctgtggctccaaagtacagacttttaacccctgaaataaacttgaataaacttgactcttgagtatgggagcctttttagggtaagatccatcctgtgtacaatagaaaagtatgatattgattgcccaggtcatattttaacagaaatgtgttcttcccaactctctgctctactttttccatctgtactctctgtccttctggctgttatactgtaactttctagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtaggtttaaaaccacccacccactcactcctctagactgtgttctgtctgatggtgtgattacttctgtgcttgacctgggctgtctgtttccatcaatctcctgggactgctcaaagcaggaaagggtagatttagttcaaaattttacccaacctttgaaaatcatttaactttttgcaccctcttaagtcttagtaccttggagcaaattcttaatgatgtccttgtcacagcctgccctccagaggacaggagtcagaaggaatgttctaaatatcctctgtcttcctcgttacggatatctgattctgggtcagtcttgcccgtgcatctaagtggaactgaggatctacgtcaacttttacctacaaaagtaatcattaaatattcttttgagatgaagtctttttatgttgcccaggctgaccttgaattcctaggctcaagtaatcctcctgcctcagcctcctgagtagctgggactacaggcacatgttactatgccaagcttaaacatttttgatggcatactggcactatcagtaaattaaatgttgagaaggcacccccaattgtgtctatttatttagaaattacacagtgccatactacttttgttagttattgattgctacttaacaaatcacctcaaaccttggcagcttaaaataacaaatatctattaattcatgggttctttgggtcagaaattcagagtgacttagtggttctggtacaaggtctttcatgaggtgtggtcaagatgttggccagggctgcatcatctgaaagcatggctgggcctcatctgagacggctcattcatggctgttggcaggaggcctcggttcctcactgcatgggcctgtccataaagctgcttgagtatccaaatgatgccacagctggcttccctccaagcaagctatcgggaagctgcagtgtcctttaagtaagtcactaagatcaacccacactcaagaggagaggaattaagcctcacctgtcgaagggaggaatatcaaataatgtcaggacttatttcaaaactacttcattttataatgccatattttcttttcaaatctgttgtggctcttagaagtgcatgttttagactctcggattttactatacagtggattagtgttgaaagggattgatggatgtgagtgtgggggccaattgaggacttgctgcagaaaagtgtgatagggagagaagggagctaacccttgtggagcactttctgcaggctgggcactgatgtctgttcccttctgccaaaggaggtaatgggaagacctacaggactagatggggttgcagacccattataccatgtataccatcaggggccacagctcactgtcttggatgttgtaaccacattttcacccacctgtaatttttttgtagtgattttacatttttatactcttttcagttcctatatgtctaagaccgtaatatggttcagttgttaactctttgaaagacaacaaggagaaggaaatctttgcattttgaggctgattttttttaactggataatgcaaatgtgatgacctcatcctgcctccccgcaaagatgcctgtcatgtgaagcgttatagcttcatatcgatccctctgaaagaaagctgtgcattgttccatctggggtattagtcttataaattgtggaagtagtgccagtcatggactgtggctatcctgtgtcccctacaggtggagaaggtgaagcgggggcaacgaacagcaacttctcttcctgttgtgaacttcgggtcccctctgagaagatgtgagttttctggaggcattcctaagagaccatcttctcctgtgatatccaagtaagcatctctcccctttgccagacagtctgactgtcatgagtcagtttgctagggctttgtgccatccagtgttgcagctcctgctcccccgtgaggcgtggccagccagaagtggtaagtgggagaaatgctggccttggagttacgtggcttgactctctgtgtatcttctgggtgaaagatcctttgctaagggaccccagtgcgtaacagggcttttatttaccaagatgatgcattcagcattttctctttaggtccatgaattccattctgcttttctggtattctttttccagttgcatttggatttaagtgattgcattgggcttgggctcctcctgacattctcccccaccttgttgtctctctctttaatagagagacaataataacttgtcagccatgatcaacagtattttaatgaagcaaatatatatgtgtgtgtgtttttaagaaatggggtcttgttgggttgcccaggcctggagtacagtgactgttcacaggcataatcacagcacgctatagcctccaactcctgggctcaagtgatccccccgcctcagactcccaagtagctgggaccactatgcccatgcaccataacaccaccatgcctaatttttgttaggaactaggtaaactcaccaaggaaaccatgtaactgaaaaatttacaataactttgtgaccaccaaggtcttaagtcattaaaatattttactgacagtaactgacaaaagactcagtaaataactcagtccagtaggacagtggaaaccatctttagtaggacagagaaagaaagagaaatatgatttaatttgggaatataggaaagtttttatatggagagaatcatataaaccttattcagtgtatcagtttagttcagagaatgttggataaacacaagtttaatgaaaacttgcgaatttgtcaaaaatatttaaagatgacatcagctcttaaatttccaatgtgttgctttctaatagagactttttcactactattaataattttttttagagatcactatggttttgatacactactaatacctgccattgatgtgtttgtcctccataaggaaaatctttccatagcacatcactgaattaaaagcctacttttctttctttctttatttttagttcattgcaacctttctgtgctagtattgcccatctttggttatggtgttgttatcctaccacctctttaaatttattatgtggactctacgatccgtttccctctgtcttatatctgagcctttttcagcttccacccatgcatcattactctggtgttaattttggacatttgcattaacagaaagaaaagcctagtttacgctgagacttttacaggctccaccctctctctgtcttgctggaatttggactcatggtccctgcagggatactagcttgcaagtttcatcattattattgtaaatggtagtatcttctatagaaatgagaattataggtatacctagttttgttgtactttgcacttcgcaaatactggttttttttgttgttgttgttgtttgttttacaaattgaaggtttgtggcaaccctgcattgagcatgtctgtcgatgccatttttccaatagtgtgtgctcacttcttgtctctgtgtcacattttggcaattctcaaaatatccaaacttcattattattattatatccattatggtgatctgtgatcaatgatctttgatgttactgttataattgttttggggtgccatgaattgcacccatataagatgacaaacttaatgtgtgtgttctgacagctccactgacaggccattcccccatctccctctccttggatctgtctacaccctgagacagagtaatattgaaatgaggccaattgataacccaacaatggcctcttagtgtccaagtaaaaggaagtgccacagatctctccctttaaatcaaaagctagaaatgattgagctcagtgaggaaggcacatcaaatctgacatgggctgaaggctaggcctctggcaccagttagccaagtcatgaatgcaaaggaaaagttattgaaggaaattaaaagtgctactccagtgaacacacaaaccataagaaagggaaacagcctgtgttagtcagggttctccagagggacagaactaataggatagatgtatatataaaggggagtttattaaggagtattaactcacacgatcacaaggtaaagtcccacaatagaccatctgcaagctgaggagcaaggaagccagtccgagtcccaaaacctcaaaagtagggaagccgacagtgcagcctttagtctgtggtcgaaggtccaagagtccaaaagctgaagaacttagagtccagtgtttgagggcaggaagcacccagcatgggagaagtaggccagaagactaagccagtctagtcgtccttccacactcttccacctgctttttttttttttttttttttttgagatggagtcttgctctgtcaccaggctggagtgcagtggcgcaatctcggctcactgcaacctctgcctcccaggttcaagcgattcccctgcctcagcctcccgagtagctgggattacaggcatgcactaccatgcccagctaattttttatattttagtagagacggggtttcaccacattggccaggatggtctccatctcctgaccttgtgatccgcccaccttggcctcccaaagtgctgggattacaggtgtgagccaccttcacctgcttttatcctagccatgctggcagctgattagatggtacccacccagattgagggtgggtctgcctcttccagtccactgactcaaatgttaatcttcttggcaacaccctcacagacacacccaggaacaatactttgcatccttcaatccaatccagttgaaactcaatattaaccatcacaagtccacctcttgtcgacttgaacccatacacatctcctgagatcatacataatcttcaaataaagacaaataataaggtcgtaattacgcctatccttcctacaactggaagcataccaatccccaacccaaatgctattacataaagttaacacttaaatgctgatatgacatcaataaatcttatgtcacatgataaaggaaagagaaaggaaatgacaatagtttcttcatccaccatgaaggtggataaggcattccatgggtccacagatggtagtcttggcagaagcattgcatgcaggatagacaaacctatatccagagtaagggtatacatgcacaaacatgttcttaacaaaataaggaagaaatactcatgcaattacagtcctcgtttctgcaactggtcctgtgatcgtagctggtactgatgactcccttcttctactacccattctgtattctctttgccttcagcaaacacctcagcaggtcgttgtcttttacctggtggagtgacccaaagtttcactcctgaagggtctgggccatttgtagtcctgccaggattgggctcttgtagttttccattgaccttaatcacagggcatggtaaaactaagagatgccctaagggatctcctgtattccacgcatactctttcttacctccattgtggagtagtaaactgatttcatcttgatagtctgggtcaatcaccccagtcaacactaactgtcttcttagcctgttgagttagaggtaggaggagcttaaagtgtccagggggcaatctttgttgtatctcctggtggcagcattcctccctctggaactaagacctctaggccagcagaacgtaatgttgcgggaacaggaagcaaaaattttgctaatgggtcactaggggtgatggtgagtggtgccacttccatttccaccccttgattcctggacccgtgaatcctggctgtgggagaaacagtaccatgtataggacgttgattcagaacatacacagccttgtgaagaactttgccccagccttgcaaagtattgttacctaattggcattgtaattgtgacttcaaaaggccattccactgttctatcaatccagctgcttcaagataatggggaatatgttaagaccagtgaattccatgagcatgagcccactgctgcacttctttagccgtaaagtgagtgccttgttcagaggcaatgctatgtggaataccatgaaggtggataaggcattccatgggtctacagacagtagtcttggcagaagcattgcgtgcaggatagacaaacctatatccagagtaagtatctattccagcgagtacaaactgctgcccttttcatgatggaagaggtccagtataatcaacctgccaccaagtagttggctgatcaccttgaggaatggtgcatatcgagggctcagagttggtctctgctgctggcagattgggcactcagcagtggccgtagctaggtcagccttggtgagtggaaatctgtgttgctgagcccatgtgtaacctctatccctgccaccgtggccactttgttcatggacccattgtgcaatgacagaggtggctggggaaagaggctgagtggtgtccacagaacgagtcatcctatccacttgattattaaaatcctcctctactgaggtcacccgttggtgagcattcacatgggatacaaatgtcctcagtttttgaccactcagagaggtccatccacatatctcttccccaaatttctttgtcaccaattttccaatcatgcttcttccaagtccctaaccgtccagccaaaccattggctacagcccatgaatcagtatataatcacatatctgaccatttctccttccaagtaaagcgcataaccaggtgcagtgctcggagttgtgcccactgggaagatttcccttcaccactgtccttcaggaatgtcccagaaaggggctgtagtgccgtagctgtccactttcaggtggtgcctgcatatcatccacagccatctgtaaatcaggccctagtcttctcttcctctgtcaactgatcatagggaaccgcccaccaccacccatgaggccatcggtgcgggctgggggagagaaggcagggtgacagggcatttgagccacttcctcatgtaatttgcttgtgccctcaggacctgctcgagcccgatcatgtatataccatttccacttgatgatagaatgctgctgtgcacaccccactttatggctagataggtcagaaagcacccagttcatgataggcagttcagatcacaaggaatggcttccttgctcctcagcttgcagatggcctattgtgggacttcaccttgtggttgtgagtcagtactccttaataaactcccctttatatatacatctatcctattacttctgtccctctagaagtattttggtaccaggagtagttctagaggaacagaatattaaggatggagttctttcgttggttttggggtttctggagttggcttctcagaagcaaggtcacaactggctcactggctctgtgctgcttctttgaagttgaaaatccttttttttttttttttttttttgagatggagtctcacactgtcacccaggctggagtgcagtggtgcgatctcagctcactgcaacctctgcctccagggttcaagtgattctcctgcctcagcctcccaagtagctgggattacaggggtgcgccaccacgcccggctaatttttgtatgtttcgtagagatggggtttcaccatgttggccaggctggtctcgaattcctgacctcgtgatccgcccaccttggcctcccaaagtgctgggattacaggcatgagccaccgcgcctggccgaaaatctttttttaaaaaacttttattttagtttcaggggcacatgtgcaggtttgttctatagatgaattgtgtgtcacaggccaggcgcggtggctcacacctatagtcccagcactttgagaggccaaggtgggtggatcacaaggtcaggtgtttgagaccagcctggccaacatagtgaaaccccgtctctacaaaaaatacaaaaaattagccaggcgtggtggcacgcacctgtaatcccagctactcgggaggctgaggcaggagaatcgcttgaacccgggaggcggaggttgcagtgagctgagatcgcgccacttccagcccaggcaacagtgcaagactccgtctcaaaaaataaaaaataaaataaattgcctgtcacaggggtttggtgtacatattattttgccacccaggtaataagcatagtacccagtgggtagttttttgattctcaccctcctcccacgctccaccctcaagtaggccccaatatctgttgttcccttcttcacgtgcaagtgtactcattgtttagctcccattaataagtgagaatatacagtgtctggttttctgtttctgcattagttcacttagaataatgtgaagtcgaaaatgttgaagaagattgtgtttctagaactattttatacacacacacacacacacacacacacacacacatatatattttttttgagacggagtcttgctctgtcgcccaggctggagtgcaacggtgcaatctcggcccactgcaacctctgcctcccaggttcaagcgattctcctgcctcagcctcccaaatagctgggactactggtgcgcgccaccacacccacctaattttttgtggggtttttttgtttttgtttttgtttttagtagagatggggtttcaccatgttagccaggatggtctcaatctcctgaccttgtgatatgcctgcctcagcctcccaaagtgctgagattacaggtgtgagcaaccacgcctggccaactattttatattttaaaggacacatcatctgagttttgtaaaagctgtccctgatcaaagggacttggttaaaattccagacttttttatgcagtttaatttagagaaaaaaaatttaatttccactctgtctagaacactagtaggcacatagtaggtgctataaatatttgtggaatgaatgaatgcaggtcactatgcccagtgcctcagagaatccccaaatgagtgagaacagtccctatttcaaggaacctccagcaaggtgcggggagccttgtacacagttgagcacagtacaggccctaatccaaagagccgcccatctgctcaggactctgctcagccatcatcctctccatagccagccaaagctgaattcacccccttctctgtgttgacagagcatcatgtgcagccctctttcattcactcacttaacatccagccctcttctaagggctgaggatgcaaaagtccctaccctcctggagcttatgtgacagtgaacagcatggataagatcaggtggcgataagcactatggaaaaaaaattaaaccggttcagatgacagaggggtggaagggagtagctggataaggtggtcaggaaaggattctctgagaaggtgacattatagcagagccatgcaggaaactagggcataggcggggttggtctatgcctcattgcttggtgttagtattttatacttagcaatctcctgctagactgctatgaggttgggaactgtcttgatttattgttgcacagtaggtgctcagtatgtgtgtgtgttagtctgtttggctgctaaactgactggcttataaacaacagagatgtatttctcacagttccggaggctgggaagtccatgatcaaggtatggccagagtcagtgtcaattgagggcccatttcttgattcatgaacaaccatcttctcagtgtgtcctcacatgatggaaggggcgcaagggagctctctggggtctcttttataagggcactgatgccattcaggaggattccaccttcatgacctaatcacctcccaaaggccccacctcctaataccaccaccatggggttagggtttcaactcacatgttttgaggagacagaaacattcagacatagcagtggtatgggatgcaactaagaagggaaggagaagctggggggcaagggcagggtcacctggcagatagggaaaatgttgagaccaaacctgctcaaggactttgccctttgttcactcctgagctcaaatgacccacctgcccctgcctcccaaagtgctcaggttacaggtgcgagccactgcacctggccagttatatcattctgtttttttttttttttttttttttttttggagacagggtctcactctgtcgcccagtctggagtgcagtggctcagtctctgctcacagcaacctttgcctggcaggttcaagcaattttcctgcctcagcctcccaaatagctgggattacaggcatgcaccaccacgtctggctaatttttgtatatttagtagagacagggtttcactatattggccaggccggttttgaactcctgacctcaagtgatccacccgccttggcctcccaaagtgctgtgattacaggtgtgagccaccgcgcccggccatttatatcattctttataccttacaagttttgtaaatattctcttgcatactcattgttggaaaaacataataaaaaagacttacttgatttttagaatgatgccacacacaaaacaaacccccaccaaaactggtatttttgacattccttctgtgcagaccaagtgtgtgatttttaaaacgcactggaaatgatgtggctttgaaaaggggcttaattagccctatgaactcacccatccagaatcccaggcaggtcatgtgattaatgataccttttcctgtgacctcctaagctctgacagtgcattgttctcctgcctgatgtcagataaactaagccactgttgggtggctgtgcatgttaatagcattgctcttttaagcgttcaagtttatttttattgttttcatcattgggtacttgcatgggttttagaaaactagattcaacaacactctgaaagacatagatggagcatagctttgttcccataacctagagaaaagaaatccagtgtggccaagtggatttgtccagcccatctctacctcttgagtgttgatgctgcctgtacttccaggtcttcagtgtgaaatattctctaatggttttatattcttagaaatatattctaagtcagtttggtcattacgataggtaatatttcagctatctattactgctgttacaaagcccccaaaattgagttgcttaaacagtaatttattattcattttcacagttctgtgacttgggcttactgggaggttctctctttggatcttttgtgcagttgctctgtgggttgacttgggttactcagggtcttccatgccattgcagtccagtgttgactggagctgcagttacctagagctcagatgagctgaaggttcaagatgggccattttcctacctggcagttgatgatggctattggctgggagctcagctgagtctgtcaaaccagagtgcctactatggcttctctgtatggcttaggcttctcacagtgactgggttccaacaagaaatggccccaagattgagcatcttttgggtcaggaagcggaagctgtcaggccagtgaaggactatgctctcaattggcacagccttacttgtctgctgtattttataggtcaaagcagtcgggccaacctagattcaatgggatggagagataaactcaaaagataagatcttgtgggatgggagatattattgtggccaactttggaaaattcagtgtgccaaagataatcacttccagaggtagatcatagctgagatcagttttgtttcagggacctagtttaatttcactttatcatgtgttgaaaacaaaacatattccatatgagggaaaaaattaggataaaggtgtctggatggcccaaaacaagtacctcccactttactccaaatcacaggcccgtggaaggctccctcccagacccaggctatccctttggtggctgaggacatttaatggatcctggccaagtgcccttcccataagcttctctgggagatgtgtggcttggttatcctctcccacagataagcatctacagcacactaggctcccacaagggcgacttaactgctgtttttgccaccacatcattctctagtaggcttttacattcttacctgaaattcttcctgaagagggtaattgaaaatgtcaagtgatgtcccctccttgcagccatatctatatactcactcagtcctgtatttttgagtcttatcagaggatcatttgaatttagaccaattttttcagcttttaaatttcgaaatcatttcaaccttgcaaaagaatcacaagactagaacacagaactctttcttccccaccttttatcctgtattaatgtgtagccacatttctgtcatccttcccatcccctatcaccctcactcagtcttgcacagtctctcacattcatcctccatagatgcacacacagacatacatacccagatttctcccagaaccgtttgagagtaacttgcagacatcatacccctttgcccctaagaacgaagacattattttccattgttatggaaatcagaaagtttaacttggtactgttacttaatttctaatgtatgtgcaacttttgccaggtgtcccagtaagattctgggtttttttgagacagactcttgctctgtggcccatgctggagtgccgtgctgtgatctcggcttactgcaacctccgcctcccaggttcaagtgattctcctgcctcagcctcccgagtagctgggattacaggggcacaccaccatacctggctaatttttgtgtttttattagagatggggtttcaccatgttggccaggctggtctcaaactcctgacctcaagtgatctgcctgcctcgccctctcctttgtactgggagtacaggcatgagccaccaggtctggcccaataagattttttatatcattttttttttcatggtccagggtccaacccagggtcccacattgcatttaattgtctcaccttcttagtcttctttcaactgaaacagttcctcagccattctttttcctgaccttgacattattttattttattttattttattttattttattttattttattttatttttcgagatggtgactccctctgtcactgaggctggagtgcagtggtgcaatctcggctcactgcaacctccgcctcccgggttcaagtgattctcctgcctcagcctcccgagtagctgggactacaggcacatgccaccacacccggctaattttttgtatttttagtagagacggggtttcaccatgttagccaggatggtctcgatctcctgacctcgtgatccacccgcctcagcctcccaaagtgctgggattacaggcgtgagccactgcacccggctgaccttgacatttttaaagaatataggctagtcgtcttgaggactgccttcagtttggataggcctgacgtttcctctgattgcattcaggttgtgttctttgggcaggaatctcgtggcagaggtgttgggtccttctcagtacctcttatcaggaggctatgatgtcagtttgtttaattactggtgatattaactttgattactggattaaggtggtgttcccaggtttctccggtataaaactgctgctctttcttatctaggaagtaacaaacttttctgaatgttggctgagctgtgctgatgaagccaagacccctcccatgcagtgagtgggccgtgttcactcactgtgcatggagtcaagtggttttggagaacatggaactagattccaagattggaggaaaaaagtcttttgggggttccactttgcagtcaactcacattcagaggcatgacaaccctctccagagagttattcttgccactgtgtttacagaggtgtttgttcgtattttctgccagtcatggaacctaaaaggttatatcatactgccttatgttcctagaaggtctagtttaccatcctaaacacaccttgtgaatcccctttgttatatttttattggaccttaaaaaattaaagtggaagagctaaaaaagtgagacaatgaacaaatgccttgagtgccagccctggtactcttgtctgtttgcatttctttgggaaaggttgtttaaactcttaggactttggttttcttctgtaaaatatggttaatagcaatttcctacgtacctcactggattactgtggcaatcaaatagacccttgttaaatagatgagaaggtacttcagaataaacctccatacaagcacagtgagttcccctaattaattcatatttcttaaatcagccaaaatacctatttccaggaaattgaaaaatagcttgccagactttctttggctttcagcaatgtgagcagggctggccagagagccgtgcagtctgacataccagccttgtggtttagtttcttccggatacctgtgcttagcacttttgcagggcagctgacagggtacaaagtccatgtaagcaagtggcaaagcaggatgagcaggaaacttgacagattgtagataacattgggaacttcttttttttaattctgtattttgttcactcactgtaaaaaaaaaaaaaatctatgacttgcccacacttttctaatttgaaggtcatgtttgtgtgtgcatacaagtgtgtgtgttttctaacttactctgtttattgggcaggggctggggtcggggactgtaaacagacttcttaatgagctttatcccaaagaatccacccttacttctcaggtagaagttatttttaaatgtgtgctcatgggtaattggtccagttttatttagaatggaacctcgcagtctgtggcgtgaactgaacctacatgtgaccattctcttaaaacaagcaaggctgttcagggctatgccaacttgaggctgtcagaacctcccccacctaggccaccctggccttttctccctaggattaggatcttgtcctgcatttccatttacttagatgggtctgacatagccaacaggctcctgccacactgactgagtgtgtgagccatttaagcagacacagaggttgtgctggaactcagatgctggctatggctgctgaggctgcagccagttcaggcctcccacccactccccccagtccagccctggagacccttgtggtcggagtcatgtctgcaggaaggcttcttgtctgcctacccattcatgggcagaagtgccagcacacttcagggacccccgaagcagagcccaactctttctatactgcttagagaagcccagagtgtgggctcgcaggccagttccagggagagaacaagaacaggcagggttgtgcacacccagcagctttgctcattctcaccaatcagagaaatcgtacctcattccacggggaggagggtgagggcaagcaagaagatcaggtgagatttgccaggccttccaatgccagaaagtcctcctcaacaggtcaaggtaggaatgcttatgggatgagaaagtgtttccatctgttatcatctaccacgagatagtctttcctacagcctctatcgccaagtttcaaatccactccctgcccttgtactgttgttggatcaaaggacacatatcattcacgtgacaatccagtggagagataatgtgctttgatcttggcaaggcactagaccaagtcttttgagacaccctcgtggtggttgggtggcgggtatacagctctactgtgggcgccactcaccttagataacagcgtgaaaggaagacgtggccaagcaaaagaccaccagctgtatctttatacatattaactgagactaaatgcaggctcagctaatgtgtacagttagtacacattgtgtaactcattggaaaaccatgctcaatggagcactgtcagtgtgagcaagcaggacatgggctcccctgttattacagttcatcttcctggttttggttcattcttgtctgtgaggattatttggatttttagtttatcatctaattgatcaacaccaatacctaacagctattgagtgcctactctatgccagttctataaagaacatcttggggtcttggtgaccccaaactcagacttagctgcgctggcaacacaggaagtagagcagagctgtaagaaggctctgtggcttagttcactgtgggaagccatttcacctctctaagcctagttttctcatctgtaaagaggccatgataatagtacctgtgtcataccatttacacacatatgtacacaaatatgtgtctgtagacatttagcagcctagtggctggtgtgtagacagcactcagtaaacatggacacaactgcagagagtgtgaatggaggtctgagctccaaatggccagggtaaggacctggtctgactgtgtcagaacacatgaggactcaacgtgctgaatcgtagaggcactcacacattacctctcaagccaaggctctcaggagcctcaaggtcaccatggggattggacactacccctccaagcagaacagctccactcttacctactgggtacagacagagtgtgtgtgcatctgtctctgtctctgtctgtctctgtctctctctctctctctctctctctctctctctccccccgccttctctctccctctctccctctctttctctctccctctctccctctctttctctctccctctctccctccccgccctaccccatgtctcagggattctcagttgagggagatcttgtccctaaggggacgtttagcaatgtctgaaggcatttttggttgtcataacctgcgtggggagcggactgctgctggcatctagtgaatggaggccagggatgctgctaaacatcccacagtgcccaggacaaccccacaacaaagcactatccagccccaaatgtcagtgatgccaggttgaggaagcctgctctgcgggcgtatatgtatggcggggcagggggattctctgcatggcttttatttggtaaaagtctaggaaaaaatagaagatcagcgttatatagtgtacctggaaaaaaccacctgattgctaagcactctgaaaaaccacatcccttaggagaacccgagtgtggggcctgagcccaaggccagaggggagaatagtctgcagagagtcgaagcaccatccacaaagacaaggtgtcttgggagttctgagttgctccaggcctaatggcatgaggacacagggaagccacttggccaatatgaaagtccacatgccacttgaggattcttttctccttcaagaccaagtttaatattgatctgatcatatttccccttattagcaggatctgatttggtaactctaagcctctggtgaaaaatcgtctttgaatatcagggtgatttgccatttttattgctgtttttatagatcaaaaaagtcagatattagcaattcatggttcaacctgctgaggattgagggtgatgacttgtaatttctgtatacattactttatatccttcctagaggaactctgtacaaatgcccacatccctgttcaaacctctagggaaactgggcatctcaagctaagctgttacccctgtcctgaacaagcagcactcaccaggagcccagcctaggctggcgtacctgtaacggaccctttcccagcagacataagacgagctcctgtgttttaaccaagtggcttgtcctcaccttttgcatctgcccagttgggagaagagagattcttttaaacctgagaccctccaaaaaacaccccccatccccatctcttggctgtgttccttggcatttaaaaagaaatggggaaccttgaagacttgctaagtaaaataagccagacataaaaggacaaatactgtgtcattccatttatacgagtcacctggaagaggcacattcacagagacaggaagtagaagggtgattgccaggggctgaggggaggggaatggagagttgaacgccactgaactgtacacttaaaaatggttaaaatggtaaatttggtgttatatatgttttgtcacaatttttttaaaaggagccagcatgttcattgccatatgctgaaaccagattcaaccctgatgttcacctaaaaagagggagtagggaagtgcctaatactccatctttacattgtcatgaaacctaagtgagattaggacatggcatcatcagctgggcttcttaaaatgtttccctttccaccagggccgtcttagagagaccgtatattcctgttgggctgagagcactttagtgacttttgagtgtgtgctaagccctattttccttcctctggaaggatgaaattgttcagcttgttggaactaggtgtcttaggaacagagagctctgtgttcaggcccagtaatcatcctctggcatattttttgttttccaggacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcaggtagatgctgccaccgtgccttggctttcccaagacggttctcctcagacccaatccacgtgccattctctcatgttttggggagggaaagggatttttctctggggacaagtgcatcccctcgtgcagctttcttgggtttgcacgttgctcctgagttctttccttcagtcttctgagggtcccctggaggaaatctagaggctgactccactcatggctgtggaagctcacggggatgctgagtaaaacaggcctgcatctgcacctcacgcaaaagaagatcttcctttagactttcaggcttctatgatgcagtgagttcacccagatggtggctgctgtggcacttgctagtgaccttgtctttcctcctcatgtttctattgtcttccactgtaaaatgcgtccagggttccagccagcccatgacagcttctcttgcttggtggtcgattgtgctagtctggacggcatttcccatcaccacactgggttggattttttttcacttccaactggcagctgctgtgtgagtggaatcattatattcgtttcccttgatcttttcctcttgatgcctctcctctggtgcagccttggggaagcccacagcaggcaccactgatgcaggagaggctgcgaagatcttggctgaaaagagaagacaggcccggctgcagaaggaacaggaggagcaagaacgactggagaaggaagaacaagataggtatgctagtgctcagaatttcggtgtgatctcatgtaactgttgtgttggaaagagcagcttgcctttctttttacagcgttggtattgataaaacttgaacagaagtatgggaacctagaatgtctgaactacatggaaggtgttcaggagactgagtcttatattagatgtaattattaataacaatggaactttgttcttttcggaggacctggaaactcatagctcttggatctaaatggcacaggcatcttcccattctcctcttggactttggggccaggcaggcctcctagagctatcagggaagtctgaactttgtttaaaaaatgagattctccctgggaaaacaagaggttcaagattctggttttggtcttgattctgatttccaaattgtttcctccgtcaaattatcctaactcacaccccaaagtgagagacagaggggagggttgagcagtgtcccctaggcatagggttgtgtgtaggggcaaccgcatagtctaagaacagtgaggtatggggagtcccatctgggagcaagacaaaagacatcattgcagtggtccctacaccttgaagagcatcagaatcatccggggaatgcagtaaaaacacatggactcagccctgttctgttttagtagcttgccagggtttgagaaccactgtgatgttagtaccagggtactttgtcacaatacagacagaccttccttttctgatctttttatttagagaggaaagcatgttgaaggacaaggtcgattttatcattaaattgataaaggaagccgttaggctcatcacagagtacaatccaatactgtttagagaattatcatgacaggaagcaggcaatgctgtagcacttcaaggccagcaccgaatttagagtaataaataatagaatattattgatcctttagtgaccttggtaagtctttgtggtctctgattacaggtttgctgatctattttttaaaagggacagtggggtaggtctcgacagtcccttcttgaaatttgggacttctttgattgttttcctgtttccaacattttggtcaatacagacgtgttttgtttgtttgtttgtttgttttgtcgagtggcatgtttgggctggtttgggtgggccttaaggtgtgtgaagggaggtcacaagagataaagatgaatcacaggacctcagatgacaggccttgataattgcaggccatggagataccatgtaggctctgagctggtgagtaacatgatcgtagtcgtgtgctaaagaaggtgatgttctttactttccagctaccaccgtctgtatctcccattttcttcacagcccagctcctgaaagacttgattgaacattctgtctttattttctcaactcacattcagtcttcaaacctcacacctaccactcctcctcgttgcctaactactaatcagtttcttggttggctttggccttgtcaagcttgcccttgcttctctggcctctccttcatagcctcctctgtctgcccctcatccccttaaatgttgcctgggctttcagcccttagtcctggaccagcttctctcccaacaagctctcccgaacagcactgctcccgcctgttctgccagtgtccctgccatcctgccagtttcctatggcgtcaaaagatttagggcccacattttacacaacagctttctgttgagcctttgttgtgctaaaccagctctgctctcatctcacttcccaccttcattttccctttgtcttgttttattgtccgtttctgaagctaactgcagcttgctttctaaaccttccatactttctggaacaagggaggcactaataacacatgtgtactgatgactcctaaaactatgcctgtggcccaagctctgtctagggctgcattgtccactatcagaccctctaggcacatgtggccaccaaaatatacattcagtaaaattcatttccccagccacacccgccacatttccgtgctcaagagctgcatctgagtagatgtggatccacaccacattgggcagcacaaatctatagattgttttcctactcaacagaaggttctattggatagcactggtctagaacctagagactgtatttccagctgcaataagttttcgtttgagtgtgtcccatatacatctcaaatccagcatttccaaagcagaacttagtattttttccccaaacttcccttctctttcatgagctctgtgttcccatctcctcagacacccaagtgaaaagtctcagtgctactctcagctctttcctttccttcttcttcccaatggttgtcaggtccagtcttcatcagctgtcacattggcatctctgttctctcccttcccttcccgtccctcctctccttcctcagctccagcccccatcgcttctcacctggactgtatctgttatatcccaactgagctccctgctctaggtctcctagagtttgtcccctgtccacgctgggcccacactgacctttctcaaataaatgtgattgttctcctgtcctttaacaagccagtgactcccctgcccactggatccacccgaacctgtcaacaggccttcaaggcctgccgtgaactgaccactacctgcctcttactccttgctttcctccagacaccagtgtgcaaagctccctgacattcacccatcacacggctccacacctccaaagctgtgcttttactttgcccccacgtggacttgtgctccttcctgccagacacctcttcatttctcaaaatgcaggtcaagtcttgctccctccctgtaccttttctggccctgtgcctgggacagaactgaccaccccccactcttcacccatactgagcccagctgttcagttgactaacatagcttcatttgtttacaggcctcctttccccagttagcaccttaaaaggctgggacatagtctttggatcactggtgcctggcgctcagtaaatgtacaagaaaggaacagaaggaggaagaatcctgactaagaaaccatcgtagtagtaggttaagagaacagaagggctaaagtagtatggtgaaggcagacatgcaaaagccagtctctgtggacttacacaatgccaaagaaatgggcagatttgaagttgatgctgaggtttgattctaaggtcttaggagaatggtacacccaataacaggtaaagaaaggacataaggaattggttttaaaagataaaaattattcatttgattttaggtgaggttatggtgtctacagtacgtccagatgattggagatggaattgaaggttgggggtgtaggtaaaaattagagcaatacactcgaccccaaatgagttttcctctctcttgccagaatgtgaagctttgcatagtgccacgtgggaggtgaggagtgaggaaggaaagtaccagacaacctggggctggaacacagcggccacctcttggaataagatcatcctcacatctgttttatgtttacagttaatagttaaagccacagaaatgttgccagataaaataatttagagaaaaataaagttacttgagtcaaaccgtggaaagcccaattattgtcacaaactggtaagggaaacaccatccaagtcaaggatgggggaaccagaacagaagggccaaccaggagtccagacaagcaggccctaagcagaagaacaaaagttggtccattcccaaacacaacagggcccagcccccaggctgtggatggcccaagatataaagtgagattcttagaggtggggcaggaaaccttagacgccgggtccaccctggggaaggcactggcaggaactagtaagcaggagatcttaatgggattcctagacggatcactttaagtcatgttaaaaagctaaaatagctactaggggttcacatgaaagaatattccagccagacgcaatggcttgtacctgtagtcccagctacttgaaaggctgaggtgggaggatcactagaggccaggagttcgagttgagcctgggcaacgtagagagaccccatctttttaaaaaattgaaggaaagagaatattccagttagacagctccctacgagcaaggtcacgtaggcaggctaaagtttcttgtcgaagcaagagttagcccaggccaggaaccacaggcagaggtcttcgaggctgctcagacctggctttttgctgctgagcctacaggtggcaggtggttttggtgagagctagggcaggtgggggcacatgcgatgtggggcagcaggatgtagcagcagctgaggcaggaagggaaagccaagagaggtaggagagagccagggtcatgcagccttatgtagcacagggctgtagggagagccacatgggcaggacttttgataagacataggcttatcaaagacgaaggctgttggtcttgggatttaggagatgaaaagagattttggagggaaattgttgagaagtaggatagagacaaagcagcctgaagagatgagtggatacaggcccagaatataagctggctgttaagcagtcatgaatgagaagcagctgagagaggactgaggagggttgcttgtgattcccgagacatgagcatttttccagggcatggaaaacatgcatgcagaaggttgaaactgacaaatgaagggaagaggggctagtgggagggacacatagctgtggaggatgtggaattcacagcacaagtggtggcatttccatctaagcagaggaacaaatggggacatttctgagcagtaatgtcatagaggagagtttaagaagctcagatcaggtggcctcagtcttctctgtatagcagttggtgataagcatcaactaaggaagatgacgaagattgagaaaagtggtaattgggactgtgtccataagggatccaggggatgaggattaaaaggccggaatgcaattgccagcaggcagataaccagccagcctcgtttacacctctctctaaccagtgattggcagcccaggagtggtcctggaaaccacccaagcctggagttgggcagcagagtgacctccatgccatctctgaaatgctcacaagggtacctaaggcctggggaacactgagagagagggaagcagacgcaagtagactgcacagcgctaaccagggcaggtcaggagagaaaaaggcagaaggatggggtgtgatcagatcaaagaagattaatgttgaaggttaggcttgttttaaaatgaaaacttttaagcacgtaagaatagagaccagtgaaacccacatactcgtccctcagattgaacaattcaagtttaagtttgtgtcagtgacatgaggaaggttaacagggagcgacagaaaagggggcgaggtgctggagtttccaacagacaggagccaatatatgaagatcctcctcaaatggccagtgacagggacaagggatgatgcatccactgaatgccaaatgatgacagtaatgcacagttttctggtactttgtacatagtgaggaaagggagagggacttgggtgaatgacaagaacaaggatggagagggtgacaggactacacacagggccaggcactggctcacacctgtaatcccagtgctttgggagaatggggtgggcggatcacttgagcccaggagtttgagaccagcctgggcaacaaaatgagacctgtctctattaaaaaaaaattcaaaaatgatccaggcatggtggcactcacccgtggtcctggctacttgggagctgaggtgggaggatcgcttgagcctgagaggttggggctgcagtaagctgtgatggcagcactgcactccaacttgggcaacagcacgaaaccctgcctctacaaagaaaaaaaaaaaaggactacacacagagctgatgaactttggaggtttagtaatgacggcaagggcggtaggctcggggtagcccacggcagagggcggtggggaaaatgatgaaatctaatgtgctgtctggttctttgagcagagacagaaggaatgctcatcctcggagaggattgtgagggacctggtttcacacaggggaagccagggttgtttgttttgttgaattttacctactttagggaagcaaagtgtggttaagggagagaacttggtatataagaggatgaaggggctgggcacagtggctcaaacctgtaatcccagcactttgggaggccaaggcaggcagatcacttgaggtcaggagttcgagaccagcctggccaacatggtgaaaccccatctctactaaaactacaaaaattagctgggcatagcggcgcatgcctgtagtcccggctacttgggaggctgaggcacaagaatcacttgaacccaggaggcagaggttgtagtgagccaagatcacaccactgtactccagcctgggcaacagagtgagactccatctcaaaaaaaaaaaaaaaaaaaaggacaagatttccctggaggtgctatggaaaggacaagcggggtctcatgggcttgtggggatttatattttgggtgataatgaggattatggaggttcaggggccataaggatgttcttacatgtgtgcatctgggcacttctgaagtcctgatggtaaaaaacaagaaacagaggccaagtgcagcggctcatgcctataatcctagcactttgggaggccgaggcaggcagatcacctgaggtcaggagtttgagaccagcctgaccaacatggtgaaaccccgtctctactaaaaatacaaaattagccagacatggtggcgcatacctgtaatcccagctagttgggaggctgaggcaggagaatcacttgcacctgggaggcagaggttgtggtgagccaaggttgcaccattgcactccaacctgggcaacaacagtgaaacgccatcaaaaaaaaaaaaaaaaaaaagagaatggattttcaggtcctggagatgaagacggcaggtcctttatgaagtagcttatacattaattaatacacaatgtatcctttgtgtgttaacttctctgggacaatcataattggctcgttaataaagggtaagaaatgaaatggtacttcagttaacctttagatacatcttgttattaacacatccattttggataatcctgtgttggacatagtatttcattgaggaatctaagaaaatgggagcttctttctgataggttctataatgctcctctccagaatatctgttaataatttgagttgtttcacaatggtttataggcattgtgacctaatttagtgttatcacgtattgttacagtctcaggctaatatatttaagtatttgtttatctttcttttaaaatatttctttgaatgaataaacaaaatatttcctttggtcatacataggctgttagcctgcacaagttctgaagctgaccattaggatggatggatgctctttttaagtcttgacctttttataacaacagcatcccagtaagtcattggcacatgcttccaaatgaaggtaatttctaaaggacatacagatttataggtgcactttaaaggacattggggcttggagagaggattcattttaaattgtaaaacaaactaacgtttgagaaccttctagggccaggcattttcattctcacagtaaagccatagaacaatagtatagcttttcccattttttaaatgggcatcaagaacattgagtgactttccaggtgtcacacagtgagtggcataatcagagtacaatttgagtcatgcccatacatcacattgccagtgattacccaaggaaagtgacgtacatgtgaggaggaggaacattagaaaggttaaaacaagctcttggactttacaggattttcccttactgcttcgagctctttaccattacaccatgaaccattcatctgactgtggatgaaaatgtctaaatgccacttaattttcatatagcaaagaaagctaaaatagatttctaaagattgccaaaataaatggaaatagaggttttaatttattaaatgtcaagtttctgttgagcattttcttccatttgctgcttcataagtcacataccaattagaaccaaattggtatgactttttgagttcgtagtcactgctcttaaattgctgactggcacatttgtggccattgagacacttcccatttttcctagctttcattggttttaaatattctgcttaggttttaaaagaattgtcattcaataagaatgatggcttggctttctgtcaccgtggtcatttgttcattgactgaggagcatctgttttcaatacagtatgcgttacacatcaacacatcattcattgctgtattacagaatttaaagtcaagcctggttaatactttttggtaaatatatggaccagagtggatttccaggaaggatgaatcatgttattaaatgaatgctcgttgaaaggtatgtgtgtgtgttaccatgtggagcattattctcggctgtcagcacacagttctctggcagtttgcttttcgagcatgtcatcttctaacaacagttgtattctcaaaaggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcaggtactgtatgagtcctcagatggactttacttgttttttaaggaccttgatagtaggtacaattagttaaatttcaatgactcataatgtttacttgaagtttcttcttaaactgtctgggctggttattaaatataagttggggcagttgcagtgaagttggtaatgtttgccatctgtgagttagggtttccccaaaggcaaaccctgggctaagaatttgagtgccagcagttttttttgcaagcgaatcccaggaagctggtagaggaataggagaaaagccaatgtaagtgcattgatgcatgtgttactgtgggtgactggaacacagtcccattgggaacctctgacagactgtggatcatgctttagaattgtccagctgagggatgaggaaactgaactacttatctaccacatcctgcccttcacggtagtagaaggtcactccctggggaattaactctctgatctggccacatgcacacttcatggcccaagcctgcccacagacacagaaaagccttggccatgtgtgagaactgtctgcaggtgatttgcatggtgagccaggggtatatgaatgaggtccaaccatgtttgctgtgtcatgcagtggtttgtataaatccacattgaatattggagcagcatccactttagggcagatgatgagatgaaggaacatgtgcaaagccagggaattaccacactgttttcttagcttattaaagctttgccttgatttacctgtttctgttagaaagaagcagcagaaacaaaggcccgggaggtagctgaacagatgcgtctcgagagagaacagattatgctgcagattgagcaggagagactggagagaaagaaggtaagggctgagggtcaggaagacctagggtaagtgaacaggaagtaaatccagttctcttctgcagtgattggatagaatgatcctaggattgtcagttaggtcaagttcattgataccactgttcaaatcttttatgtctttattagttttttgccatctcgttccatcagtgattgagaaagattgttaaaaactccatctgtagcgaggcatggtggctcacacctgtaatcccagcatttagggaggcagaggcgggaggatcacttgagcccagaagttccagaccagcttgagtaatacagtgaaaccctgtctctactaaaaatacaaaaaatagctgggtgtgatggcatgtgtctgtagtcccagctacgtaggaggttgaggtgggaagatgacctgaactcgggaagttaagcctgcagtgagccgagatcatgccactgcagtccagcctggggaacaggagtgagaccctgtcccaaataatagaaaaaagaataactccatctgtgattatggatttgtccatttttcctttcagttctgtcaggttttgttttatatatatttatcgtgatatgcctttgtctctagtgatatttcttgtcttaaagtctactttgacagccccctgccttttatttttttgagacagtctcactctattgcccatgctggagtgcagtggtgtgatctcggctcaccacaacctccacctcccaggttcaagcgattctcctgcctcagcctcccaactagctgggattacaggcgcacaccaccacacctggctaatttttgtatttttagtagagatgggatttcaccatgttggccaggctggtctcgaactcctggactcaagggatcctcctgcctcggccttccaaagtgctgggattatagacgtgagccactgtgcttggcctgacagcccttttatgattagtgtctgtatgtcaaatctttttcacccttctacttaaaacttcttctgtgtgtttttataagtaaagagcatatagccaggaattgttattttaattctgtttgacagtctttgtcttttaattggagtgtttagtccatttacactaactatacttatgggtaaaattgggtttaagcagactgattataaaggagtattctcatggtgtcctaggcccaacctgggctttgtattgctgtaggcctgggatccaggagaccagcctgtggccttctctcctgagatgcacctcagcctcagcctcactttctgtagggtggtgctctttaatggcaggtggtaatttgttgatttatacagagcctaaggagaagaaggagaaatatgggatataaatcgaatattgattctagatacgtactagttaacttctcaagcatttgaccttgtccatggggccggaggtgtacatctccaaaactagtggaaaacctttctatacttgttatcctcttctgacttttgccttttacaagttttctgagaaatgtgacattgcatgtaaaccaagctacttttatgtttttggtcttattgtcctcttacttgattttgttttttgttttttgtttttagagaatagatgaaatcatgaagagaacaaggaaaagtgatgtgtctccacaagtgaaggtaggaattcaaatgaccattttaatagtttatgtactaagtagaaaagaacagcagaatacactcagtgaaattgtaggtcttggcgacgattagccagaaaaaaatgcagttttcctgctttgttcctggctaggttaaggagggttaggtacctgaaaagaaagaggggcttcagaggtgggatgggtaagagatttccttagagtcatgggaggtgggatgaagagagaggcatagtagtccatgaataaaaaagagaatcctgacataaaaatacgtaagaataagggaaacacagctgaagatttaaagaattaccacagaacaggcagatggtccaggctcaaaatatcatcggatgcttttaaaaagtactttttttctgtgtgatgtcagccttccctcatttcattcaccttccatttgttttcagaaagaagaccccaaagtgggggtccagcctgctgtgtgtgtggaaaagaagacaaaactggttgtccccaacaaaatgggtgagtgtgacatctggttcttgggttcttccttttagtagcaaaagctcgtaagacttggtgtagggtaaacagacccatggatcccaagagggtgactgctggcaggggcctgtgcagtttcccttccctgggaatgtgtctccagcacagggactgtcagctccacttgggaacccactgggttccttggttactcccataatcccagcataggaggcactctggctgctggctcacagtgctttccagggagcttaactgctggtcaggttttattactgttaggacctgactctgctcttctccagaggttctgcacagacactgataatgtgatttgtcttctcttctcctgtgtgaaggtgattatatgggtttatttgtggctctttccacaaaagatgctgcagtatcagtgaagcagagcattaaattaattgccttgatctatatttctctgttactttatttagacattttatgattaacacaagggactttgtgttctcgatcagaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgaggtatattcatttcttttgcatttaagcctcatcacttctcgaaacactaccctttcttttagttggtttcttcgtcttttatacaaccaaatcacctaaagcaggtttgattgacattacaggaaagctctcagtggtataacattctagtgtcttgcgtcaggttccctagaagcagagcctggaacagagtttctagggcatgtgatttgttagaggaaagctcttgggagtttttcaggagaaaggggaaggagggaattcgctaagcaaggatgccttctcagctgaccccatgggagctctggaggatgaatttccaccagagacagttcctctgagcttctgcagttctggtttttctagattcttctctaagatctcacaaggaagaaaaagaagaacctggcagcagctttactctggctgttaagagattcctggtgacaggccctcagcccaccactcttcagagcctggatttgttcctttgctaggccttacagctggcgcaattatgaaactcctccttccatctctagggagaggaagagagagagagaaagaaaaccagccttggctgggctggagctggataagtcagagtggattggaagcctcactttagagaggaagcagagcgtgagattggctttgccagtgatgacgtgggctgtggtgggatcctttcattatgggccccccaaccttaactgagcacttcaggcgtttccacatgaactcttctcagcacgatcagattcacactcacaggagccctggcagagagaaacaattgttcccattttactggcgaagaaactgaggctgcaggaaggaaaagcaattcgcccaaggtggcactactagaaaggcagcactgggagccccactgttaattagggttcttcttcaacttgctttgaacttttggcattggctttctgtctgaatgtcccatttagaaagttctggaatgccttgcttctttgtggtagaatgctggtgcctgtgggtttttgtcctttcaccctttgggcaatgtgaccttggccatcacagccctgctcaatctgcttccctgttctcatacatggggcctcgtgtccaccatctgtcctcctcagatttgagcccacttgtattttttacagtgtgttacacaaaaactctgactctaaatccttcttctttagaagagtagtaaaacaaaatattgcaaatagaattaatatattgtgccatgttgtctgtctgtctctttctgcctctctccctctcgttcatctcttctagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtacagtcttttgattatattctaacttcataaccctttaactggggtttgtgaagataggatgtatatcactcagcctcttggatggtcaaattttatttgaaaaacgcaaacatgaatatattatggtatactacaacacacacaagaattgagacagatttcaattaattcatctgcgagccttcagcgccgagccgccttgtcctaaccctgctatttagggtgtgtagatgggaaagttgagaacactggctaaaggtttgactaccagtccagcctgagtagcttttttagggggcaaggaaagaatactctagtagtgttgcaaggtgatatgaataagatgaatttccccacctctagttttgctcagtgacatcccacattctatctagaatcattcatatacagggccacaggatttgctattctcttgacccattctggattcttccaaagcagacagctattcttggatcatacctgagggagagagaactgcagtttttgtgtcttgaaggttttttccccacctttggcctttttttatttttgccaaagtgcttccagaagctattctcatttgagcaagaatgtctatgagttatatacactctgtagtaaggtatacttagttacatatacctcacattttatttacttcagtttggggcttgtttttgaataaggaaaacataattagagtctgtcaccaaatcctttaataatttaataattccaattgctcctcccacttcagattctgtttttgttttcaagagaagtgatctcactctgttgtccaggctggtgtgcagtggcgcaatcacagctcactgagacttcaaactcctgggctcaggagatccccttgcctcagcctcctgagtagttggatcataggcacatgccaccaggcccagctaattttttttagtttttgtagaggttgggtcttgctatgttgcccggctggtcttgaacccctggcctcaagtgatcctctctccttggcctcccaagtacttactgggattacagccatgagctaccatgccttgcatccatttatccattttagattctttttttttttttttttttttttttgagatggaatctcactctgtcacccaggctggagtgcagtggcatgatctccactcacagccacttctacctcccaggttcaagccattctcctgcctcagcctcccgagtagctgggactacaggtgcacgccgccatgcctggctaattttttgtattttagtagagacagggtttcactgtgttgcccaagctggtctcgaactcctgagctcaggtaatctgcctgccttggcttcccaaagtgctaggattacaggcgtgagccaccgcgcccggccattttagattcttaaaagcatttttatattctcggcattttctcagtcactttattttttatacttcactcccataacaaattcactggccaaaataacagtccagtgtttttatttttcaaatgaggaaacaggtgggagaggctacagagctgaggtcactgtgttttttgtatacttgtttctacctgacctcagctcttgcctataagacaagtttgagagcccatttctcttggttcttggtgtgtggtgggtcacttttagagtaaactgtatcactggtttggaaaagcagctgccttcttggacacttaaaacactaaatcacctgagcattctatttccctgacagttacgtggcttaatatttattaagaggttttttgtgtttttaacatactttgactttaaaattagtttcccttcagttcacttacctcactatacagtaaggaacagagaatccacaaaatttattagagtattcataggtcctcaaatttatttcttacatctctaaaagaaatgcaaaacccctgtccaaaaagaaaaatctcaaattattttattcacactgcttgtatatttttaattatgattgggtctagttctcaaattcttctctaccaaaagtggtaccacccccaccaggagacgtttggacatacgttgatggtttttgttgccagagtggctgggggcatttgaaagacaaagcttgagacattaaatatctgcaggttttagaaaagttccatacaaggaaaatttgacccatctaaaagaatagtcctatgtaaaatactctatcacttctgttgagaaatactgtataagcccaggaggaaaatataattgccaagaaggtagaaagtgccacagtgtgttgtgatcgttttagtgagagaatagtgctacaaactgcacaatacttggttttccctttgatctcatctggttttgtttctgaattgacacaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgatatgtaccttgtgtttaatgtgaaatacattttcattgaagagtctgatgacttgctagcgttttattttttctgtaagctcaatgtgctgaaaccaaaccaggcttttaaaaacctgtgtagaagaaaaccaaaaaatcctgtgtgggtgtcctttccctgtcaaactcattaaaaattcctttgttgccagtgc

SEQ ID NO: 3287 - DNA, 57629 bp, human
aaaatgtctgggtaagttatgcactttggctattttggtccaagggagtggagatatggtggtgtcttttctgaagattcttagaaatttgtgaatgaatgggaactaggacagttgctagatgaacatgaagaatcaggcgtgaacctacactgcaactggcatgttcacaaataggtaattttcagaatagttcactcggcaaacattgaacctctgctgtgttctagccactgtgttagggtctgcagttacgatattgaagaaagagaaacagtcgctgcccctgatctaaggaagtcctaacaccttcaagtgtcaactgtgtacactccctcaggttctctcttgggaatctaaaagggccatcctcaggagaactgagaaaatcagcacttgagtcattttatattttaggacagagagccctggttgagaaaggccgtcttgcctcttgcaggctgtagacagattagtgcagagtgttcttcacaggatgctgagggagatagcgtttccccattgcattgagacaaatgaggagctttcaggttcttctcttcttcactgcctcctgctggtcggtacaagcattgcctcctccagggaacccttccctgccttggctaggtggaattaagggccccttagtaaatgccttgagggtaaggcaaattttgttcgtgtgttttaccccctgacttagctcagtgtctggtgcttggtgcacacacagttaaactgcttttgaatgaacatagccttataagcatcattgctcaacctagcatatagtttagccattatgcacaagtttgacttaatgacagccgtcatagtcatagctcccacgtggggaggcacttactgtgaacttcacggtcatcatcttgttcaatcttaacaacactgtgatgtggcaaacatgactgtccccacatcgtagaggaggaaaccgaggcagagagatgatctagctaacatgcttagggttacccagctagtggcagaggtaccagaaccctttatctcaatcactgcatgctaggatcctaccaggctctttttagggctctgctcttgcttccttgtttttggtcttaatccaaactgcatgggatgctctggtaatgacacctctcttctactttccttccccagctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggtaaggcccaggtgcaccctccgccaccttccagccccctcagcaggctgctcagagtgcctgggcatcctgcccagctctggggtaggagagagacctgccgtgcaccttctccttggtggctcccatgccttctttcagcaacatgacatgaaactcgaagcagcactgacatagaaccgcagagacttatccattcaactcaggtgttaatttgctgtgtgatcttgggcaaactggttggcttctctgggccttgatttgtgtgtctgtgaagtgagggttggatttggcagtctccaatgcctcttttagtcataaccttttctgactctaagactcaaagggtccctggtggtctagtagataggggaaaaaaaaaaagactcagaggagattgtgggtagcggctgggtgaggtgaatctgaggattacagatgggagttcatgcctccagggcaggcacaaggccagaacaagagcttgtgaggttgagaacaatgtgatcctgtcagttgctactggcaaattagtctaccctcaaataccaagatgctaatatatttaaagtttaatgtagttcttcgctttaattgctctttccagttaccttttaaaaaagaaatggcacataattacccctacagagttctttattactaaattttgaaaatatatttagaaagcatatttggattatagattttcttcacgattatatttttaggaggtaataaaaaccttatgtcagttgatgataattttttattcataaggtataatgattcatcttttagtatgaacaatatagaggtttggtaatctccaaccctataggatatgaagatgtttgtacaaattcagtattttttaaaatctctgaacagttgcttatcactatatatatttaccccttccttcttttttttttaaagaacacatacgaaaacacacacatagtcagacccatctttgcccaagaagcaccctttcatggtgatttctttcctcctcttagaaaatgaggtctaagccagtgtcttagctatggttcaccgttattggctgcagtctgattgctgtgccttcatctgctcccagttcaaatgtcagctccaatgccagctctaccactgagcagctggtggccaggggcaagtcacatgcccctctaactctgtctccttagcccaaaacagaggtagttacaggaattaaaagaggtgacttttgtaaaagtgcccagcaaagcacctagcacagagtaatcgttcaggaatgttacattctgtttagttacttcagctgagcttggctaaagcaaggtcaagagggtgctacccacaaaagcttatgaaacagagtcagtagatgggaaaaagccacagtataataggctgttttggtaacttgggacagatttctcctttcctaacttctgtgttaagagttgctggactcacccattttcttcccatcctccattccttgatgacttagagcttgtcctcttcttccatgatctctccattttgaaagcttgtcactgctgcttccaggaaggggtactgtgaagtcacataagacacttcccatgctctgacatatgcattgtcactgggggctgcttttgaggcaatttctgtttataatttttctctacagaacattagtgctggaggcatgttaaattaagtagaacagctcccccttcttggaggtgagggagttttatgccatatggttggtcctgatgcagctgaatcttttgtggtttcccttctgggtaattttctatttgtgtgcttccttgcacccctaatgtggtggagggaagcaggaggctgcccgaccgacccttgtcagcccaagctgagcttggttccctcttctccctgggcacagcagggcagggctgagggctgggcctcctgtggttgtgtagcaacccaaggaaacagcagcctccttctgccacctgctcctgccctcagggtcccaggggacccaggtgtagcttagggacttgccacacacaggctggcttgttagctacattgggtcggtgctctgctggcacagaggcctttttggcattctcgtgggtgacatttagggagaagggatcagcctgcattacggaagcccctcttcaaaggaaaccctctgcactggcccctatgattcaaggggagctctgggagggctgcagcctgctcagtgcctggctgtggatgttctccattctcttctcagtgtcagattgaagtctttttttttttttttttttttttggtcatgttctgtctctgtcagccagagaaaagcctctgcaggaagatcattcatcctatgcaggccattttacttctctagcctgttggaaagtgtttgttgcccaccaaatcctgcctctctgggtctgatacttaggagctcatgagaggcctgttgaccccaccccagccctgccctggctctgtacccctatggttgccatgatgtcactcttgataacccctcatgtctgtgccagggcagaagtgggtaccaccaatggcctgtctctcagaggtcttaagagttggcagaggtcttaagagtagtcaggcctgtcccagggaggggtcccagggaggggtggggtggttctactgtccacttgacaccctgaccttaaactcattctcttgctggaggccacctactccttaagttcttagaaccttcacgtgccacacagctcccaggaaccaagctaccagaacaagttcctgtcacctgtgttagggctgacaacacagtatgccagcccattctcagggcagtatagcttcctgaccagtggccctggaaaattggatttggaaaagccaacttcatgttccttatgctaaacagaaaagagaaaggcctctttctctttctttctttctttctttctttctttctttctttctttctttctttctttctttctctctctctctctctcttttcttttcttttcttttctttcttttctgcacacatccctgctgaggaccgctgggggtgtgtccctgcagtgtcatccccagaacacatgtaatgggccgggcatggtggcttatgcctgtaatcccagcactttggggagccaaggcaggtggatcacctgaggtcaggagttcaagaccagcctggccaacatggtgaaaacccatctctactaaaaatacaaaaattagacagacttggtggtgctcacctgtaatcccagttacttaggaggctgaggtgagagaatcacttgaacctaggaggtggaggttgcagtgagcagagatcgcaccactgcactccagcctaggtgacaaagcaagactctgtctcaaaaaaaaaaaaaagaacacatataatggcagttgaaaaggcacagccaccccctaccacccattcctgccagagactgctgtctgagtaacagtgtctggaatgtgccctgctggcaacctttaatactgttcagccagttcagcggggtcaccttggtcgtgattctccaagttcatccagacagatctaaagccagacctcaaggcatcaagtgtgaggctcgctccttccttctttccttccttatctccctttccttcctttctatctttccttccttcctctctttccttccttctttttttccttccttctttccttccttccttcctatctatcctttcttccttcctgtctttcttccttcctatctttccttccttccttccttccttccttccttccacccttccttccttccttccttccttccttccttccttccacccttccactaagccctacctaatagaggagattctagggacgaggatttgccttgccctttccccatcctctgttgatcatcagatgatactcaggagaaccagaacttggcaggaattgcagtatgcagttctgatatttattaatactgtttttctaatgtgatggaactttctcatgctcactttctgttgctcagcctttcctctaaccagtggctcttgcttgggggtcccatgaccagcagcacctgggaacttgttagaaatgcagattctcagcaggctccaccccagacctattgactcagaaactctggggataaaccccaggattttaataattcctccaggggattctcctacctgatctctcagatttgagaactattgctctaaatggtcctgataagaatcttcctctttaaattcagattcacttagctttggttaaggacttactgcatactagtcattatcaaatagacttagagtgatctggtgatgtaggtaagctcatccccattttataggcaaggaaactgaagcccaggactgcaatgttagctcaaggtcacagggataaaaagtgtcaggcagaggtgggatttgaatccttacctcctgattccaaatctgagatcctttctgtttcgtcatatgaaggaacaaaaaggtacacacaaacacgaggcaatactgacctattcaggactaaccttaaataagacttgtgcactggacaagttttgttttctatatgtatgaatcaccccattctgactttttggggttccataaatcctcttctcttagaacttgcttatcatctatttctcatcatctctccaaaagtgggtgatacaaagtgagtgtgtctttctctcagggacaactgtgttttcatcggcctcctcaaggtctgaaggaatgaatctccagtggtgggatttggagcagctcagtggactggggatggatggcaggggtagtttttctagaggccattgaaaagtccaggggcaggtctggctttcagtgagcactcattcccttacaagggtgccccccagatagctgatcagtggtcaggctggttcagtgaagctcactattctttcttttcattggtcccctagtagagaagggaccactttgtgaggtccttctggcatgtaggaaatctaccgtaacccacccaatacttaattcactctaggatgaaaggtttcaacacttcagttaggtcattggttaaatactttacgttaaaccgtataatgaaatactattcagccccaatctcgagtggctgtacttcaggcatcacatggcagagaagttctcttccttccaagccccagcttttatcaggcagactgccagagttggccatcatcgtttaatgggccagggtcgtgaggactggactctgccaaggcatgcatactcacgattgtagagtctcaggccaaatacaagagcacagttaatagctaatacaaatctaagagttacaggaggtaaaaatccccctttctgcttacaggtccctggagaggcagtctcttagcaaagtgctattcagagaaaaattatgtagaggaggctgagatgtggagaagccagatcctcatctcatccctctggtatagacagaagggataaatccagatacctattaagtgacctttatatgtttctagtaagtgtgacataaaggagcctttcctgatctttaagtcatggttactcagttgatgatgtcctaaattaattttgcttctgtgtgtatttttttaagccatgacaattgtatctttttgttttagaatgggctatgattagcccagttcctggagcacctcggggttgggttttatgagggcaaaagggtgtcattataactgctagctcaggccttctccagtggagatagggagaggagttggtatttgcagtgtcacggaggtggtggggagtgcagaattagagcaccttcactgcagcagcaaggacaactttatgaaagtaacaatttgggtaatacaggagagtgtttttgataaatactgttacgagagaagccgaagcctaatggttgtttttctcttctggttaaaaattactgggttctgcctccctgcctcctccacctaagtaactctgggaacgcatggatgcttttttttttgtggccagaaggttctttactcttgcctcttgaaaattttgaaatatgcaatattatcccagattactatatagcagaaaagcgtcacactatgtaaaacagttggttcccctttaagaagttctaagatgaaaatgcagctttgcaaaatagatctcagtgtcatgtatcaccccaaaaactcaaattatatttgcattaaaattttctcaaagcaaaatgttttatgcttttaactagaaaggatgctcttggttctggagcagaattccagctctcctggttagggcaaaatgccttgagataggcctcaaggagttaatgcttattgggcattattcctagggcagcttctccccagggaggggaggggacaggacacacggtgtttaggttgagagccagtgctagcctagccgcattgtttactctccacctactcagaacacgctggtgtggcagagagagcacgtatgcctgggttttggatgctgagcacagaaagccccatttggtgactcacactgtgcactgaggcagcaggtagtgtggtggggctgggtagttaatcttgttaacacttgccttacacgaactgtgtaggaacggctggaggcgatgatgcgccggtccctggagcgcacacagcagctggagctgaaaaagaagtattcgtggggagcaccactggccattggacccggaggacatgatggtgagtgtagggttgcccctgtatttcaggtcctgggtgggaaataatggagcaggcaggggattatgggcaccactgggtgtctccaggatctgggggatgctttgcacagcttttcagaggcaccactttcagatgtgatgtttaaaactgccaagattcctacgcatgcatttgttatgaaggggatctgtgcattcttcttgatagcaaacagcagttgacacaaaaactgggttttgagggagagcaaaagagaagactttgaacgcagagcccagtgagctgggcccagctggcaagcccagggttgttctgacttcaggggagggaaacggcaggaggctctgtcactggtccagatgcgatcaggaaaagcacagtggcagttatcctccaaaaagggctggactatttcctgctgcattttaaatttttgttgctttttcgactttgtttcaaggtgacttatttcattaccagttcaaactcatctttaaattttcaaatgtgtaatttaatatatggattgttactagtctctggatggcttttccttcttttcagtgtctcactacatttcagcgatcttagcattctattatgcaggaggtgtgtactagctctatctgagagcaaatggatttgtgtttacaggacagttcttgactttgctgtattgtgcttttcacctttgggcagtaaatatactttattttttcttttttgaaaagtcaacaacccatttcagttactttttctaatttcctaattagaaactaagaagcaacaagaaattgggacttttttcttttacctctctttgctctgattttttgctgtgtaggtgaatcagaaaataccccaccccctcctctaggtttagcagccagcaccctccctccggatgcagggaccactgccgcagctgccgagtccaccaacggtatatccgagcatcactgtgccatagcattttgtgataactgttctgatcatcctcccccatcaccatgtctgcgtcaagcacttttacaattggtttcttagtctggcctgtcacaatttttttttcctagcaatgtgaatgacatgcccatatttctttgttcctctgtcattatagagcggtgcatgccttacatcttagtgccccggagacatttcatcctcaactcactaacgtctgccttgaaaatcttgtcagtgttggatttttgcacactcagatctttaacaatctcttcatcatctgttgtagacattaagaagcagggcatttctgattacttctggttaccaaaacctgtaatcacccggagttctgaatggagaacttgggcttagtgttaaagtgatagattcctggagaggtgtttgagagggagtggtaggaattttatcagtgctaacactggtaatccaaataattagataatttggctttgtgcttgattttatttaataggctgtctgttttgtatacaggcctgggaaactcctctggtctagatcaagaacagaactagccaaactttgtttccatttaataatgactttagaaattcaatccatcttcaactggcaaagaaaaaaaaaaaaagctgtaaaagggatgcaatatttaccaacaatgcggaaggtcatattagcagtaggaatcaatatccttggtttctgacattcctttgacaatgaataatccttactgggggtgcttcgtaacagcagttttgctgcacaagcagagttacctctagtgtgggcactggctttccccctaagaaaggtgcaggggggctgggcgtggtggcttgtgcctgtaatcccagcactttgggaggctgaggcaggcggattgcttgatgtcagtagttcgagaccagcctggccaacatggtaaaaccccgcctctactaaaaatacaaaaattagtcaagtgtggtggcgggtgcctggagccccagctactcaggaggctgaggcaagagaattgcttgaacccgggaggcagaggttgcagtgagatcgtaccagtgccctccagcctgggcaacggagcaagactctgtcttgaaaaaaaaagaaaaaagaaaggtgcagagaggtggagtaatcacccactgggaatcagcacccagggcccgggccagggtgaaatgagtgcagtacttgactagagcatacaatttaagggagtgccaaaaatctcagtaataaagataaaataatatcttaatgtgatattttttaaaatccaaattaatgcaaaacaatccataataaacaacaaatttctaaagactggtgccatgctgagcacatcagagcctgaagcaaaagggaaaatgtgtactcctatatacgtggttttatgtaatttctaatgtttagttttatcaaaacattaaagtagtttaaaatatggaaaaattgaaaagagtattaaaactcatataatttcaactttaaatagttttatttctacacaaatcaaatttattgtacttttacttcagctttagttaattaaaaattaccgggccaggtgcagtggctcacgcctgtaatcccagcactttgggaggctgaggcagatcacgaggtcaagagatcgagaccatcctggccaacatggtgaaacactgtctctactaaaaatacaaaaattagctgggcgtggtggcatgcacctgtagtcccagctactcaggaggttgaggcaggagaatcacttgaacccgggaggcggaggttgcagtgagccgagatcgtgccactgcactctagcctgggagacagagcaagactctgtctcaaaaaaaaaattatttaagattgtcatttggtcagcagaaattatagaacatcgcagttcttatggcagttctcatgggaaaacacgatgagcagaggagtagattttgaaaatattattgatgagtttgcttttttacaaccaagagcacacatttttcttttggcctcaggctctaacttagcttggcagggcactgtcagcatctctttgtttgccgtctgaaataatgactggaacgtaagaacaccaaactcagggtcgcctgttaaaatgctaacctcaaacagttaaagcatttgcaaaaggaccattttgatctgtctcttactaagtaagaaaaggaaaaccaactgctaaagaggccgttctgctttaaatacaactctgagaggacggatttcatctctctccaacctgagctacagataaccttcataaaagagtcggtttcagcaagcggtgacagtcagaccatagggcgttttccagtggtgatttgtctctgggtccaagttggttttgtttttgtgtgatgtgagcatgctcaaaaatccctagacaaaagaaaatgatttgttggtgggattaacacggcttcagttgaacagttgagtgaggttgaacatttgaaattgaagatgacaacacagtgaagaagttgcagagattttgctgcagaccaagggctgctgtagcctggtcatttctagagtaggataatgagatgccaggatgatgaaagcagagcatgctgtgccacagcatttaggaggtgcgtggatgaggacaggaaggacacttcgggatatgtgtttcttggttctacagtagtgtgatgaataccaatgtctttaatgcatttctctgcagcatgtgacaaactttcaacatcaactatgagtttgccaaagccaacggagcctcccatgaataaacgcctgtcttcatccaccgtggcaatatcctattccccagaccgaggcaagtgaacatgtagacttggtctctctagtttgtttcttttctggtgtgagcatcttaacgtttgtctttgtgagagtctcctcttgagccttctgcagataccgtcattgtcctagtcttgtggtctgaatgtgggagctctagggccttgtcagtgggactttggaacgtggcacggctctttagagccaggtcgttgttgaatagaggtaggaattaatgcagtctcccagtctgaaagagactgttctgttttccacattgcatgtaggagttatcctgcccaggaattaattaaccagtgggcagatgtgaccattaaagtaactgcctggtcaatgatggaatacagttgattagccagaaagagcagaattgataagttatagttatatgggaggcttagatatgtgaaaaaatggggttctgcagtcatctgtggtttataggcctgcccattttgtagatgaaaagagaagcacagaactaatgaggcctctaaaagaggaaaaggttgggtggcgctctgttttgagttaggagatgatgtgtatgggacgtgtgccagttccagaacctgagtagatttaacagggtctgcattctcacaaaggctcagataagtcactgaaagtctgtttatacctttcagagtatacaggttaaggaaatgacggaagctctccatgcactaaatgtttattctaaagcaacattgaagaagtatcaggtgccagtggagtgtttagcacaagttatcaccaagggcagagcaaaaggctggttgcgacttggcagaggctggtgtgccttcctggttgtttccactgacattgaccttgtacctctatcccagaggcatattatgtgtgtcagagaccctataaggttcataatgctactgatctgtgatgcagttcatggtaagcaccaggaacctggaagtgatgaagagctgaatacagagtgagggaaaagttaattcattgccatatataatacattcaaaactgatctaaatattttggtcattgacttccagattatgaatactactatttgtctttcattaaagctgataatcagttggctgtttgtatttttgtgcctctcacttaatttttacccttattgacatgtaaaaagtatgaaaagatatatttttatactattacaagatgacattttatttaaaaatcagtgtgttatgaaatgcttcttagcgcaggacctaaaacaagtgttttataggcataatttgttttctacttggagtaaaggtttttttgttgttgttttttttgttttttttttgtttgttttttttttgagacaggctctctgttgcacaggctagagtgcagtgatacagtcttggctcactgcaaactctgcctcccgggctcaagccatcctctcacttcagcctcaagtagctgggactacaggcgcatgtcaccatgcccagctaatttttttgtattttttgtagagacgaggtttcgccacgttgcccagggtggtctcaaattcttgagttcaagtgacccgactgccttggcctcccaaagtgctgggataacaagcatgagccaccatgcctggccataaatgatttcctgagtccatattacatctgggaggtgggctaattctctgagtgatacaggttactgtactgcaatagcatattgaatggattttggtacctagtgacaattaatgcactctcccaaactctaaaggacacattatttgttttattttacgatgacaaattccaaatccatcctttgttcaaatatttttattttccatgttctgccacccaaaagttaatttgcaccatgcattgtgttgtttaaatgttttattttgttttgttttaattttgctttttaaaattttcatttgattccatccctcagctcatcacatgcaccttagtccaatggaagccattcttgtttcgcgactgttgacacccacacagtcttctttagccagaagcagagcttcagtcatgctctctgggcaggccaatgattcaggtaaaagaggctaagctggtaacaccaaggaaaatgcccgaagaggtgttggtcagcctaggatttactcctgaatttttggattttgcttcctatttgctggctttgtgaaaagtcttcattggttaataacgtcttataccagtgttttgctgttttatgtttcttttgagtgtcacagaggtgagtaaattatcttatgagtgagagcatgttctttaggggaagaaaaccccacttgatgaactctggaggttagtagacttttcttaagagacggtgtggcaaaacagcctgtagaccagtctggggtgtcccatagccagctctaccactcactagctctcaccattgggggtaagttaattaacttctttaagcctcagttttctcatctataagatggagctattttaaattattttgaagattaaatgagagagtgcatgcaaatgagatagcacaatgattagcacagaatgaaagctagaaactttgagaagtttctagcctcactactcaaaaggtggtccatggaccagcaatggcagcagcatctaggagcttggttggaaggccccacctagcctgcacactgaagtctgagaaacactggaccagaccatcaaagccctgcctttatcaaagcagatcaagtcgtcatgtcaggatttgtggcggctggcattctctttgtttccagatgagcagcactgtgtccacctaaggtcaggtctactctctgttctccagatagtgtactcagttgtgatgatacataaatgagataaaacttctgcctagttgtagctgcttccaaacagttatactgtttctgcaaataagttgtacagatagctaataggttcataagatgctcaacatcattaatcattagggaaatgcaaatcaaaaccatagtgggatgccactttacacccactaggatgactagaatttttttaaaaggggaaataaccacgtgttggtggaggtgtggagacactcttccctcacacactgctggtgggaatgtaaaatgatgcagctactgtagaacacagtctgaccgttgctcaaaaacttaagcatagagttcccatacgacccagcaattccactcctaggtatacagccaaggaaattaaaaacatatgtttgcacaaaaacttattcacaatagccacaaagtggaaagaaaatatgatatacccataaagtagaatattattcagctataaaaagaaatacaggccaggcatggtggctcacacctgtaatctcagcactatgggaggccaaggtgggcagttcacttgaggtagggagttcgagaccagcatggccaacatagtgaaaccccatctctactaaaaatacaaaaattagctgggtgtggtggtgcacacctgtaatcccagctactcgggaggctaagacaggagaatcacttgagcccaggaggtggagactgtagtgagccgagattgcaccactgtactccagcttgggtgacacagcgagactccatctcaaaaaaaaaaaaaaaaaaatacagatacatgccacaagatggatgaaccttgaaaatgtgctaagtgaaagaaaccagttgcaaaaggccacatattgtgtgcttctatttatgtgaaatgtctgaaataggaaaatccatggagatggacaatagatggtggttatcagagactggaggagggaaggaaggggagtgactgcttaacggacgaagtttctttggggaatcttgaaaatgtttttagaagtagactgtggttatggttccacaaccttgcaaatgtagcaaaacctccaaattgtatgtgtatatgtatacgtatacatatacgtatacatatatgtatatatatgtatatgtatttaaagacagggtcttgctcttttaccctggctagaatgcagtgatgtgatcatagctcactgcagcctcgaactccaagccctcctctcacctcagcttcccaagtagctgggactacaggcacacaccaccatgcctggctaattttttgggttctttggagggacaaggtctcactatgttgctcaggctggtctcaaactcttgggctcaagcgcgacccatctactttggcctcccaaagttctaggattacaggtatgagccaccatgcctgtcctgtatactttttaaagggtgaattttatggtatatgaattatgtatcaaaaaaccctagcaagtaggaagtaccccattttgagaataaggaatatgttggggttccctaagagcaactccaggatcagtgatttgctaggaagactcacaggatccccagtgaaaggatgcaagcaaagtcagcaaaggagaaagacacatgggacaaagtcctgggaagaccaggcacaagcttgcagagtcctctctggtggagtcactcaggacgcctttcaccccagcaatgagttacgacaacatgtatgaaatgttgccaaccagggaagctttttagagactcagtgccaacggtttttacagagggctggtcacatgtactccatgcccagcacatacccaaattccaggttcccagaaggaaagcaggtattcaacatacaccatgttgtttgtttatgccctgtgagccactcaacagttaaagggggatcgtcctaaaatgtacgttcccaggtgctggctaaaggctaaccttgtaagcaggccttagtagggacagcagtcaggcttgctatgttaactcatttttgcacagctcacccacttgacccttggccaaggtgtctttacagaaaatttttcagtagggccccacatagcagggggtgagaccatcctgcagtattgatctcagttatgtcctttaggggttctgggacttagcagttaaagcaaatctcattaaccagaaggtctgtcttttttttctctctttcttttctttttctttttcttatttatttatttatttatttattttggagacaaggtcttgctctgttgctcttagccacgctggagtgcagtggcatgatcatggctcactgtggcctcaacctcctaggcttaagtgatcatcccacctaagtctcctgagtagctaggactataggtgtgtgctaccacacttagctaattttttttttttttttttgtagagatagggtcttcctatgttgcccaagttggtctcaaactctgggactcaagcgatcctcccacctcggcctcccaaagtgctgggattacaggcttaagccactgcacctggccttagaaaggtctgtttgaggcagccaggtggcctcctccatcagttgctgtatgaatctttttacctggcctgtggcatcagctcaggcccagaacagctctggccagtaagttgaaactgatctgaatgccttccaggcctgacgccgtgtcatgataatcgtggcacgcacataggaactatgatccccaagggctcatgtggttccctggaaaaaaagagttgaagatgttagggcacactagcagggtatcattggtcagtcagttcccagtgtggcctcccactgtggtgactggtgcctcagggtgctcagtccagtgcaggtaattcagctcagtcccaggttttatggcggctgcctgaggccatcagtcccaaacagttctaccagtgaccctacttcatcttcctggcaagtgcagatggcatctggagctgttctgtggggacatgtaggaactggccccactcctgccggctcatagtcatgctgtcacatgccatctaggctcagccatgggtctgagtccaaggtgctttcagcacaaggagttttccttcaggaaggagagcgcttccaggagcagttatggaaaacagaacacaaatgtccttccgtatccctgtatcatttttaccccaggtgttggattatgttgtttttctccatgtcctattcaataatcaaaactttacattttcttaatcatcccctactctcacccagacctttcaaagaaaggacaaaagcatttcttaaaacccatttttatccaacttaaccagaaagatatattgtgttcaggtattaggctaaaatcctaagttttcgaaacattttaaagtaggtttgtatcacctctgagccctttcatcttgatcattttatccagtgagcagcctagaaaagatcaatccctttccagtgacagctgcatttaacaaattgctttactgacgtgtgtagtgagagaaaggtagaggaaatatagtcaggatctcagtctattacaaactgcagctactccagaaaattaaacacaaagcatcaacagcagtgacactttccccagagggaatggagttcagtctgtcagggatggctgaaagagtcacattgcctgtggtgtgacttggagcttttgtaggaatcatgtgttgggaatataatcagactctgcatcagaaataatagagccaatgagcagcttgattgtggatggtcccatcagagaacaagccctgtcttgtgggcacttgtatgtgacccagtctagcagcatccagaatctttttacagttttgggccccatgaagggcattctatatttgtagtggtccctactcgatttttaaaactccagaagcatgtcttttcctagaaattgcctgtcttttcatatctccccttttcaagaggctccattagacaaaagtcatagcagaaaaatctactacagagacttgttctggttctaatatttggagtttaaattccagcctacccactgctggcaaaaagcaaggaggttgtgtctaactctcacttggaggagaaaacaaaaaccaaaggcatcacttgggctgtgctttttccctcactttagctagcatgctacagtcaaaagcagccagggggatccatcaagccaactctcttggagctgtattggtcatctttaaattccgtaggtcacttttacctctcaaaacagctcagctgctgttttataccatggataacttcatagccacccaggcatcacaagtttgttctccacccttttgtccttttcccaaaatgtgattttaccacgtttcagcaaatcagggtcattccagcaattcccatttctgacactagttgtgccagagttccccaagaccaccccaggtttgatgattggctaggagaacttggaagaatcagcatagttccacgcatggctgtgacttattttttctttcttagctttttttttttttttttttttttttcgagatggggtctttctctgtcacccaggttggagtgtagtggcgcgatcttgactcactgcagcctcaactttccaggctcaagcgatcctcctgcctcagcctccagagtagttgggactacaggagtgtgcccccatgccaagctaatttttgtattttttgaagggctgtggtttcaccatgttgccaaggctggtctcaacctcctaagctcaggtgagccaccatgcccggcccatggctatgatttattatagcaggaggaaacatgaaaaaactagcaaatggaggaggtgcatgggactaagttcagaagtaaccaggtgtggatttccaagagtcttcttccagtggagtcacatgggacgagcttaattcctctaccaacacattgtgacaacatgtatgaaatgttgccaggctgggaagttggctagaaactcagtgcccagggtttttactgggggctagatatgtaggcatcccctcccaggcacatacccagattccacactcccacaagaaaagcagatgcttagcataaaccatactgtttgtataaacagtttagacacccatcagttaatggtgggaaccctcctgaaatctaagttctcagatgccagccaagggccacccttataagcaggcctttccaagcacagcagtcagatctgctatgttaacccttttgtgcacaaggaaatcgatgtttagagaggttaagtaacctgcccaaggtgatccagctattaggtggcagtgctaggtctctgtggctccaaagtacagacttttaacccctgaaataaacttgaataaacttgactcttgagtatgggagcctttttagggtaagatccatcctgtgtacaatagaaaagtatgatattgattgcccaggtcatattttaacagaaatgtgttcttcccaactctctgctctactttttccatctgtactctctgtccttctggctgttatactgtaactttctagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtaggtttaaaaccacccacccactcactcctctagactgtgttctgtctgatggtgtgattacttctgtgcttgacctgggctgtctgtttccatcaatctcctgggactgctcaaagcaggaaagggtagatttagttcaaaattttacccaacctttgaaaatcatttaactttttgcaccctcttaagtcttagtaccttggagcaaattcttaatgatgtccttgtcacagcctgccctccagaggacaggagtcagaaggaatgttctaaatatcctctgtcttcctcgttacggatatctgattctgggtcagtcttgcccgtgcatctaagtggaactgaggatctacgtcaacttttacctacaaaagtaatcattaaatattcttttgagatgaagtctttttatgttgcccaggctgaccttgaattcctaggctcaagtaatcctcctgcctcagcctcctgagtagctgggactacaggcacatgttactatgccaagcttaaacatttttgatggcatactggcactatcagtaaattaaatgttgagaaggcacccccaattgtgtctatttatttagaaattacacagtgccatactacttttgttagttattgattgctacttaacaaatcacctcaaaccttggcagcttaaaataacaaatatctattaattcatgggttctttgggtcagaaattcagagtgacttagtggttctggtacaaggtctttcatgaggtgtggtcaagatgttggccagggctgcatcatctgaaagcatggctgggcctcatctgagacggctcattcatggctgttggcaggaggcctcggttcctcactgcatgggcctgtccataaagctgcttgagtatccaaatgatgccacagctggcttccctccaagcaagctatcgggaagctgcagtgtcctttaagtaagtcactaagatcaacccacactcaagaggagaggaattaagcctcacctgtcgaagggaggaatatcaaataatgtcaggacttatttcaaaactacttcattttataatgccatattttcttttcaaatctgttgtggctcttagaagtgcatgttttagactctcggattttactatacagtggattagtgttgaaagggattgatggatgtgagtgtgggggccaattgaggacttgctgcagaaaagtgtgatagggagagaagggagctaacccttgtggagcactttctgcaggctgggcactgatgtctgttcccttctgccaaaggaggtaatgggaagacctacaggactagatggggttgcagacccattataccatgtataccatcaggggccacagctcactgtcttggatgttgtaaccacattttcacccacctgtaatttttttgtagtgattttacatttttatactcttttcagttcctatatgtctaagaccgtaatatggttcagttgttaactctttgaaagacaacaaggagaaggaaatctttgcattttgaggctgattttttttaactggataatgcaaatgtgatgacctcatcctgcctccccgcaaagatgcctgtcatgtgaagcgttatagcttcatatcgatccctctgaaagaaagctgtgcattgttccatctggggtattagtcttataaattgtggaagtagtgccagtcatggactgtggctatcctgtgtcccctacaggtggagaaggtgaagcgggggcaacgaacagcaacttctcttcctgttgtgaacttcgggtcccctctgagaagatgtgagttttctggaggcattcctaagagaccatcttctcctgtgatatccaagtaagcatctctcccctttgccagacagtctgactgtcatgagtcagtttgctagggctttgtgccatccagtgttgcagctcctgctcccccgtgaggcgtggccagccagaagtggtaagtgggagaaatgctggccttggagttacgtggcttgactctctgtgtatcttctgggtgaaagatcctttgctaagggaccccagtgcgtaacagggcttttatttaccaagatgatgcattcagcattttctctttaggtccatgaattccattctgcttttctggtattctttttccagttgcatttggatttaagtgattgcattgggcttgggctcctcctgacattctcccccaccttgttgtctctctctttaatagagagacaataataacttgtcagccatgatcaacagtattttaatgaagcaaatatatatgtgtgtgtgtttttaagaaatggggtcttgttgggttgcccaggcctggagtacagtgactgttcacaggcataatcacagcacgctatagcctccaactcctgggctcaagtgatccccccgcctcagactcccaagtagctgggaccactatgcccatgcaccataacaccaccatgcctaatttttgttaggaactaggtaaactcaccaaggaaaccatgtaactgaaaaatttacaataactttgtgaccaccaaggtcttaagtcattaaaatattttactgacagtaactgacaaaagactcagtaaataactcagtccagtaggacagtggaaaccatctttagtaggacagagaaagaaagagaaatatgatttaatttgggaatataggaaagtttttatatggagagaatcatataaaccttattcagtgtatcagtttagttcagagaatgttggataaacacaagtttaatgaaaacttgcgaatttgtcaaaaatatttaaagatgacatcagctcttaaatttccaatgtgttgctttctaatagagactttttcactactattaataattttttttagagatcactatggttttgatacactactaatacctgccattgatgtgtttgtcctccataaggaaaatctttccatagcacatcactgaattaaaagcctacttttctttctttctttatttttagttcattgcaacctttctgtgctagtattgcccatctttggttatggtgttgttatcctaccacctctttaaatttattatgtggactctacgatccgtttccctctgtcttatatctgagcctttttcagcttccacccatgcatcattactctggtgttaattttggacatttgcattaacagaaagaaaagcctagtttacgctgagacttttacaggctccaccctctctctgtcttgctggaatttggactcatggtccctgcagggatactagcttgcaagtttcatcattattattgtaaatggtagtatcttctatagaaatgagaattataggtatacctagttttgttgtactttgcacttcgcaaatactggttttttttgttgttgttgttgtttgttttacaaattgaaggtttgtggcaaccctgcattgagcatgtctgtcgatgccatttttccaatagtgtgtgctcacttcttgtctctgtgtcacattttggcaattctcaaaatatccaaacttcattattattattatatccattatggtgatctgtgatcaatgatctttgatgttactgttataattgttttggggtgccatgaattgcacccatataagatgacaaacttaatgtgtgtgttctgacagctccactgacaggccattcccccatctccctctccttggatctgtctacaccctgagacagagtaatattgaaatgaggccaattgataacccaacaatggcctcttagtgtccaagtaaaaggaagtgccacagatctctccctttaaatcaaaagctagaaatgattgagctcagtgaggaaggcacatcaaatctgacatgggctgaaggctaggcctctggcaccagttagccaagtcatgaatgcaaaggaaaagttattgaaggaaattaaaagtgctactccagtgaacacacaaaccataagaaagggaaacagcctgtgttagtcagggttctccagagggacagaactaataggatagatgtatatataaaggggagtttattaaggagtattaactcacacgatcacaaggtaaagtcccacaatagaccatctgcaagctgaggagcaaggaagccagtccgagtcccaaaacctcaaaagtagggaagccgacagtgcagcctttagtctgtggtcgaaggtccaagagtccaaaagctgaagaacttagagtccagtgtttgagggcaggaagcacccagcatgggagaagtaggccagaagactaagccagtctagtcgtccttccacactcttccacctgctttttttttttttttttttttttgagatggagtcttgctctgtcaccaggctggagtgcagtggcgcaatctcggctcactgcaacctctgcctcccaggttcaagcgattcccctgcctcagcctcccgagtagctgggattacaggcatgcactaccatgcccagctaattttttatattttagtagagacggggtttcaccacattggccaggatggtctccatctcctgaccttgtgatccgcccaccttggcctcccaaagtgctgggattacaggtgtgagccaccttcacctgcttttatcctagccatgctggcagctgattagatggtacccacccagattgagggtgggtctgcctcttccagtccactgactcaaatgttaatcttcttggcaacaccctcacagacacacccaggaacaatactttgcatccttcaatccaatccagttgaaactcaatattaaccatcacaagtccacctcttgtcgacttgaacccatacacatctcctgagatcatacataatcttcaaataaagacaaataataaggtcgtaattacgcctatccttcctacaactggaagcataccaatccccaacccaaatgctattacataaagttaacacttaaatgctgatatgacatcaataaatcttatgtcacatgataaaggaaagagaaaggaaatgacaatagtttcttcatccaccatgaaggtggataaggcattccatgggtccacagatggtagtcttggcagaagcattgcatgcaggatagacaaacctatatccagagtaagggtatacatgcacaaacatgttcttaacaaaataaggaagaaatactcatgcaattacagtcctcgtttctgcaactggtcctgtgatcgtagctggtactgatgactcccttcttctactacccattctgtattctctttgccttcagcaaacacctcagcaggtcgttgtcttttacctggtggagtgacccaaagtttcactcctgaagggtctgggccatttgtagtcctgccaggattgggctcttgtagttttccattgaccttaatcacagggcatggtaaaactaagagatgccctaagggatctcctgtattccacgcatactctttcttacctccattgtggagtagtaaactgatttcatcttgatagtctgggtcaatcaccccagtcaacactaactgtcttcttagcctgttgagttagaggtaggaggagcttaaagtgtccagggggcaatctttgttgtatctcctggtggcagcattcctccctctggaactaagacctctaggccagcagaacgtaatgttgcgggaacaggaagcaaaaattttgctaatgggtcactaggggtgatggtgagtggtgccacttccatttccaccccttgattcctggacccgtgaatcctggctgtgggagaaacagtaccatgtataggacgttgattcagaacatacacagccttgtgaagaactttgccccagccttgcaaagtattgttacctaattggcattgtaattgtgacttcaaaaggccattccactgttctatcaatccagctgcttcaagataatggggaatatgttaagaccagtgaattccatgagcatgagcccactgctgcacttctttagccgtaaagtgagtgccttgttcagaggcaatgctatgtggaataccatgaaggtggataaggcattccatgggtctacagacagtagtcttggcagaagcattgcgtgcaggatagacaaacctatatccagagtaagtatctattccagcgagtacaaactgctgcccttttcatgatggaagaggtccagtataatcaacctgccaccaagtagttggctgatcaccttgaggaatggtgcatatcgagggctcagagttggtctctgctgctggcagattgggcactcagcagtggccgtagctaggtcagccttggtgagtggaaatctgtgttgctgagcccatgtgtaacctctatccctgccaccgtggccactttgttcatggacccattgtgcaatgacagaggtggctggggaaagaggctgagtggtgtccacagaacgagtcatcctatccacttgattattaaaatcctcctctactgaggtcacccgttggtgagcattcacatgggatacaaatgtcctcagtttttgaccactcagagaggtccatccacatatctcttccccaaatttctttgtcaccaattttccaatcatgcttcttccaagtccctaaccgtccagccaaaccattggctacagcccatgaatcagtatataatcacatatctgaccatttctccttccaagtaaagcgcataaccaggtgcagtgctcggagttgtgcccactgggaagatttcccttcaccactgtccttcaggaatgtcccagaaaggggctgtagtgccgtagctgtccactttcaggtggtgcctgcatatcatccacagccatctgtaaatcaggccctagtcttctcttcctctgtcaactgatcatagggaaccgcccaccaccacccatgaggccatcggtgcgggctgggggagagaaggcagggtgacagggcatttgagccacttcctcatgtaatttgcttgtgccctcaggacctgctcgagcccgatcatgtatataccatttccacttgatgatagaatgctgctgtgcacaccccactttatggctagataggtcagaaagcacccagttcatgataggcagttcagatcacaaggaatggcttccttgctcctcagcttgcagatggcctattgtgggacttcaccttgtggttgtgagtcagtactccttaataaactcccctttatatatacatctatcctattacttctgtccctctagaagtattttggtaccaggagtagttctagaggaacagaatattaaggatggagttctttcgttggttttggggtttctggagttggcttctcagaagcaaggtcacaactggctcactggctctgtgctgcttctttgaagttgaaaatccttttttttttttttttttttttgagatggagtctcacactgtcacccaggctggagtgcagtggtgcgatctcagctcactgcaacctctgcctccagggttcaagtgattctcctgcctcagcctcccaagtagctgggattacaggggtgcgccaccacgcccggctaatttttgtatgtttcgtagagatggggtttcaccatgttggccaggctggtctcgaattcctgacctcgtgatccgcccaccttggcctcccaaagtgctgggattacaggcatgagccaccgcgcctggccgaaaatctttttttaaaaaacttttattttagtttcaggggcacatgtgcaggtttgttctatagatgaattgtgtgtcacaggccaggcgcggtggctcacacctatagtcccagcactttgagaggccaaggtgggtggatcacaaggtcaggtgtttgagaccagcctggccaacatagtgaaaccccgtctctacaaaaaatacaaaaaattagccaggcgtggtggcacgcacctgtaatcccagctactcgggaggctgaggcaggagaatcgcttgaacccgggaggcggaggttgcagtgagctgagatcgcgccacttccagcccaggcaacagtgcaagactccgtctcaaaaaataaaaaataaaataaattgcctgtcacaggggtttggtgtacatattattttgccacccaggtaataagcatagtacccagtgggtagttttttgattctcaccctcctcccacgctccaccctcaagtaggccccaatatctgttgttcccttcttcacgtgcaagtgtactcattgtttagctcccattaataagtgagaatatacagtgtctggttttctgtttctgcattagttcacttagaataatgtgaagtcgaaaatgttgaagaagattgtgtttctagaactattttatacacacacacacacacacacacacacacacacatatatattttttttgagacggagtcttgctctgtcgcccaggctggagtgcaacggtgcaatctcggcccactgcaacctctgcctcccaggttcaagcgattctcctgcctcagcctcccaaatagctgggactactggtgcgcgccaccacacccacctaattttttgtggggtttttttgtttttgtttttgtttttagtagagatggggtttcaccatgttagccaggatggtctcaatctcctgaccttgtgatatgcctgcctcagcctcccaaagtgctgagattacaggtgtgagcaaccacgcctggccaactattttatattttaaaggacacatcatctgagttttgtaaaagctgtccctgatcaaagggacttggttaaaattccagacttttttatgcagtttaatttagagaaaaaaaatttaatttccactctgtctagaacactagtaggcacatagtaggtgctataaatatttgtggaatgaatgaatgcaggtcactatgcccagtgcctcagagaatccccaaatgagtgagaacagtccctatttcaaggaacctccagcaaggtgcggggagccttgtacacagttgagcacagtacaggccctaatccaaagagccgcccatctgctcaggactctgctcagccatcatcctctccatagccagccaaagctgaattcacccccttctctgtgttgacagagcatcatgtgcagccctctttcattcactcacttaacatccagccctcttctaagggctgaggatgcaaaagtccctaccctcctggagcttatgtgacagtgaacagcatggataagatcaggtggcgataagcactatggaaaaaaaattaaaccggttcagatgacagaggggtggaagggagtagctggataaggtggtcaggaaaggattctctgagaaggtgacattatagcagagccatgcaggaaactagggcataggcggggttggtctatgcctcattgcttggtgttagtattttatacttagcaatctcctgctagactgctatgaggttgggaactgtcttgatttattgttgcacagtaggtgctcagtatgtgtgtgtgttagtctgtttggctgctaaactgactggcttataaacaacagagatgtatttctcacagttccggaggctgggaagtccatgatcaaggtatggccagagtcagtgtcaattgagggcccatttcttgattcatgaacaaccatcttctcagtgtgtcctcacatgatggaaggggcgcaagggagctctctggggtctcttttataagggcactgatgccattcaggaggattccaccttcatgacctaatcacctcccaaaggccccacctcctaataccaccaccatggggttagggtttcaactcacatgttttgaggagacagaaacattcagacatagcagtggtatgggatgcaactaagaagggaaggagaagctggggggcaagggcagggtcacctggcagatagggaaaatgttgagaccaaacctgctcaaggactttgccctttgttcactcctgagctcaaatgacccacctgcccctgcctcccaaagtgctcaggttacaggtgcgagccactgcacctggccagttatatcattctgtttttttttttttttttttttttttttggagacagggtctcactctgtcgcccagtctggagtgcagtggctcagtctctgctcacagcaacctttgcctggcaggttcaagcaattttcctgcctcagcctcccaaatagctgggattacaggcatgcaccaccacgtctggctaatttttgtatatttagtagagacagggtttcactatattggccaggccggttttgaactcctgacctcaagtgatccacccgccttggcctcccaaagtgctgtgattacaggtgtgagccaccgcgcccggccatttatatcattctttataccttacaagttttgtaaatattctcttgcatactcattgttggaaaaacataataaaaaagacttacttgatttttagaatgatgccacacacaaaacaaacccccaccaaaactggtatttttgacattccttctgtgcagaccaagtgtgtgatttttaaaacgcactggaaatgatgtggctttgaaaaggggcttaattagccctatgaactcacccatccagaatcccaggcaggtcatgtgattaatgataccttttcctgtgacctcctaagctctgacagtgcattgttctcctgcctgatgtcagataaactaagccactgttgggtggctgtgcatgttaatagcattgctcttttaagcgttcaagtttatttttattgttttcatcattgggtacttgcatgggttttagaaaactagattcaacaacactctgaaagacatagatggagcatagctttgttcccataacctagagaaaagaaatccagtgtggccaagtggatttgtccagcccatctctacctcttgagtgttgatgctgcctgtacttccaggtcttcagtgtgaaatattctctaatggttttatattcttagaaatatattctaagtcagtttggtcattacgataggtaatatttcagctatctattactgctgttacaaagcccccaaaattgagttgcttaaacagtaatttattattcattttcacagttctgtgacttgggcttactgggaggttctctctttggatcttttgtgcagttgctctgtgggttgacttgggttactcagggtcttccatgccattgcagtccagtgttgactggagctgcagttacctagagctcagatgagctgaaggttcaagatgggccattttcctacctggcagttgatgatggctattggctgggagctcagctgagtctgtcaaaccagagtgcctactatggcttctctgtatggcttaggcttctcacagtgactgggttccaacaagaaatggccccaagattgagcatcttttgggtcaggaagcggaagctgtcaggccagtgaaggactatgctctcaattggcacagccttacttgtctgctgtattttataggtcaaagcagtcgggccaacctagattcaatgggatggagagataaactcaaaagataagatcttgtgggatgggagatattattgtggccaactttggaaaattcagtgtgccaaagataatcacttccagaggtagatcatagctgagatcagttttgtttcagggacctagtttaatttcactttatcatgtgttgaaaacaaaacatattccatatgagggaaaaaattaggataaaggtgtctggatggcccaaaacaagtacctcccactttactccaaatcacaggcccgtggaaggctccctcccagacccaggctatccctttggtggctgaggacatttaatggatcctggccaagtgcccttcccataagcttctctgggagatgtgtggcttggttatcctctcccacagataagcatctacagcacactaggctcccacaagggcgacttaactgctgtttttgccaccacatcattctctagtaggcttttacattcttacctgaaattcttcctgaagagggtaattgaaaatgtcaagtgatgtcccctccttgcagccatatctatatactcactcagtcctgtatttttgagtcttatcagaggatcatttgaatttagaccaattttttcagcttttaaatttcgaaatcatttcaaccttgcaaaagaatcacaagactagaacacagaactctttcttccccaccttttatcctgtattaatgtgtagccacatttctgtcatccttcccatcccctatcaccctcactcagtcttgcacagtctctcacattcatcctccatagatgcacacacagacatacatacccagatttctcccagaaccgtttgagagtaacttgcagacatcatacccctttgcccctaagaacgaagacattattttccattgttatggaaatcagaaagtttaacttggtactgttacttaatttctaatgtatgtgcaacttttgccaggtgtcccagtaagattctgggtttttttgagacagactcttgctctgtggcccatgctggagtgccgtgctgtgatctcggcttactgcaacctccgcctcccaggttcaagtgattctcctgcctcagcctcccgagtagctgggattacaggggcacaccaccatacctggctaatttttgtgtttttattagagatggggtttcaccatgttggccaggctggtctcaaactcctgacctcaagtgatctgcctgcctcgccctctcctttgtactgggagtacaggcatgagccaccaggtctggcccaataagattttttatatcattttttttttcatggtccagggtccaacccagggtcccacattgcatttaattgtctcaccttcttagtcttctttcaactgaaacagttcctcagccattctttttcctgaccttgacattattttattttattttattttattttattttattttattttattttatttttcgagatggtgactccctctgtcactgaggctggagtgcagtggtgcaatctcggctcactgcaacctccgcctcccgggttcaagtgattctcctgcctcagcctcccgagtagctgggactacaggcacatgccaccacacccggctaattttttgtatttttagtagagacggggtttcaccatgttagccaggatggtctcgatctcctgacctcgtgatccacccgcctcagcctcccaaagtgctgggattacaggcgtgagccactgcacccggctgaccttgacatttttaaagaatataggctagtcgtcttgaggactgccttcagtttggataggcctgacgtttcctctgattgcattcaggttgtgttctttgggcaggaatctcgtggcagaggtgttgggtccttctcagtacctcttatcaggaggctatgatgtcagtttgtttaattactggtgatattaactttgattactggattaaggtggtgttcccaggtttctccggtataaaactgctgctctttcttatctaggaagtaacaaacttttctgaatgttggctgagctgtgctgatgaagccaagacccctcccatgcagtgagtgggccgtgttcactcactgtgcatggagtcaagtggttttggagaacatggaactagattccaagattggaggaaaaaagtcttttgggggttccactttgcagtcaactcacattcagaggcatgacaaccctctccagagagttattcttgccactgtgtttacagaggtgtttgttcgtattttctgccagtcatggaacctaaaaggttatatcatactgccttatgttcctagaaggtctagtttaccatcctaaacacaccttgtgaatcccctttgttatatttttattggaccttaaaaaattaaagtggaagagctaaaaaagtgagacaatgaacaaatgccttgagtgccagccctggtactcttgtctgtttgcatttctttgggaaaggttgtttaaactcttaggactttggttttcttctgtaaaatatggttaatagcaatttcctacgtacctcactggattactgtggcaatcaaatagacccttgttaaatagatgagaaggtacttcagaataaacctccatacaagcacagtgagttcccctaattaattcatatttcttaaatcagccaaaatacctatttccaggaaattgaaaaatagcttgccagactttctttggctttcagcaatgtgagcagggctggccagagagccgtgcagtctgacataccagccttgtggtttagtttcttccggatacctgtgcttagcacttttgcagggcagctgacagggtacaaagtccatgtaagcaagtggcaaagcaggatgagcaggaaacttgacagattgtagataacattgggaacttcttttttttaattctgtattttgttcactcactgtaaaaaaaaaaaaaatctatgacttgcccacacttttctaatttgaaggtcatgtttgtgtgtgcatacaagtgtgtgtgttttctaacttactctgtttattgggcaggggctggggtcggggactgtaaacagacttcttaatgagctttatcccaaagaatccacccttacttctcaggtagaagttatttttaaatgtgtgctcatgggtaattggtccagttttatttagaatggaacctcgcagtctgtggcgtgaactgaacctacatgtgaccattctcttaaaacaagcaaggctgttcagggctatgccaacttgaggctgtcagaacctcccccacctaggccaccctggccttttctccctaggattaggatcttgtcctgcatttccatttacttagatgggtctgacatagccaacaggctcctgccacactgactgagtgtgtgagccatttaagcagacacagaggttgtgctggaactcagatgctggctatggctgctgaggctgcagccagttcaggcctcccacccactccccccagtccagccctggagacccttgtggtcggagtcatgtctgcaggaaggcttcttgtctgcctacccattcatgggcagaagtgccagcacacttcagggacccccgaagcagagcccaactctttctatactgcttagagaagcccagagtgtgggctcgcaggccagttccagggagagaacaagaacaggcagggttgtgcacacccagcagctttgctcattctcaccaatcagagaaatcgtacctcattccacggggaggagggtgagggcaagcaagaagatcaggtgagatttgccaggccttccaatgccagaaagtcctcctcaacaggtcaaggtaggaatgcttatgggatgagaaagtgtttccatctgttatcatctaccacgagatagtctttcctacagcctctatcgccaagtttcaaatccactccctgcccttgtactgttgttggatcaaaggacacatatcattcacgtgacaatccagtggagagataatgtgctttgatcttggcaaggcactagaccaagtcttttgagacaccctcgtggtggttgggtggcgggtatacagctctactgtgggcgccactcaccttagataacagcgtgaaaggaagacgtggccaagcaaaagaccaccagctgtatctttatacatattaactgagactaaatgcaggctcagctaatgtgtacagttagtacacattgtgtaactcattggaaaaccatgctcaatggagcactgtcagtgtgagcaagcaggacatgggctcccctgttattacagttcatcttcctggttttggttcattcttgtctgtgaggattatttggatttttagtttatcatctaattgatcaacaccaatacctaacagctattgagtgcctactctatgccagttctataaagaacatcttggggtcttggtgaccccaaactcagacttagctgcgctggcaacacaggaagtagagcagagctgtaagaaggctctgtggcttagttcactgtgggaagccatttcacctctctaagcctagttttctcatctgtaaagaggccatgataatagtacctgtgtcataccatttacacacatatgtacacaaatatgtgtctgtagacatttagcagcctagtggctggtgtgtagacagcactcagtaaacatggacacaactgcagagagtgtgaatggaggtctgagctccaaatggccagggtaaggacctggtctgactgtgtcagaacacatgaggactcaacgtgctgaatcgtagaggcactcacacattacctctcaagccaaggctctcaggagcctcaaggtcaccatggggattggacactacccctccaagcagaacagctccactcttacctactgggtacagacagagtgtgtgtgcatctgtctctgtctctgtctgtctctgtctctctctctctctctctctctctctctctctccccccgccttctctctccctctctccctctctttctctctccctctctccctctctttctctctccctctctccctccccgccctaccccatgtctcagggattctcagttgagggagatcttgtccctaaggggacgtttagcaatgtctgaaggcatttttggttgtcataacctgcgtggggagcggactgctgctggcatctagtgaatggaggccagggatgctgctaaacatcccacagtgcccaggacaaccccacaacaaagcactatccagccccaaatgtcagtgatgccaggttgaggaagcctgctctgcgggcgtatatgtatggcggggcagggggattctctgcatggcttttatttggtaaaagtctaggaaaaaatagaagatcagcgttatatagtgtacctggaaaaaaccacctgattgctaagcactctgaaaaaccacatcccttaggagaacccgagtgtggggcctgagcccaaggccagaggggagaatagtctgcagagagtcgaagcaccatccacaaagacaaggtgtcttgggagttctgagttgctccaggcctaatggcatgaggacacagggaagccacttggccaatatgaaagtccacatgccacttgaggattcttttctccttcaagaccaagtttaatattgatctgatcatatttccccttattagcaggatctgatttggtaactctaagcctctggtgaaaaatcgtctttgaatatcagggtgatttgccatttttattgctgtttttatagatcaaaaaagtcagatattagcaattcatggttcaacctgctgaggattgagggtgatgacttgtaatttctgtatacattactttatatccttcctagaggaactctgtacaaatgcccacatccctgttcaaacctctagggaaactgggcatctcaagctaagctgttacccctgtcctgaacaagcagcactcaccaggagcccagcctaggctggcgtacctgtaacggaccctttcccagcagacataagacgagctcctgtgttttaaccaagtggcttgtcctcaccttttgcatctgcccagttgggagaagagagattcttttaaacctgagaccctccaaaaaacaccccccatccccatctcttggctgtgttccttggcatttaaaaagaaatggggaaccttgaagacttgctaagtaaaataagccagacataaaaggacaaatactgtgtcattccatttatacgagtcacctggaagaggcacattcacagagacaggaagtagaagggtgattgccaggggctgaggggaggggaatggagagttgaacgccactgaactgtacacttaaaaatggttaaaatggtaaatttggtgttatatatgttttgtcacaatttttttaaaaggagccagcatgttcattgccatatgctgaaaccagattcaaccctgatgttcacctaaaaagagggagtagggaagtgcctaatactccatctttacattgtcatgaaacctaagtgagattaggacatggcatcatcagctgggcttcttaaaatgtttccctttccaccagggccgtcttagagagaccgtatattcctgttgggctgagagcactttagtgacttttgagtgtgtgctaagccctattttccttcctctggaaggatgaaattgttcagcttgttggaactaggtgtcttaggaacagagagctctgtgttcaggcccagtaatcatcctctggcatattttttgttttccaggacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcaggtagatgctgccaccgtgccttggctttcccaagacggttctcctcagacccaatccacgtgccattctctcatgttttggggagggaaagggatttttctctggggacaagtgcatcccctcgtgcagctttcttgggtttgcacgttgctcctgagttctttccttcagtcttctgagggtcccctggaggaaatctagaggctgactccactcatggctgtggaagctcacggggatgctgagtaaaacaggcctgcatctgcacctcacgcaaaagaagatcttcctttagactttcaggcttctatgatgcagtgagttcacccagatggtggctgctgtggcacttgctagtgaccttgtctttcctcctcatgtttctattgtcttccactgtaaaatgcgtccagggttccagccagcccatgacagcttctcttgcttggtggtcgattgtgctagtctggacggcatttcccatcaccacactgggttggattttttttcacttccaactggcagctgctgtgtgagtggaatcattatattcgtttcccttgatcttttcctcttgatgcctctcctctggtgcagccttggggaagcccacagcaggcaccactgatgcaggagaggctgcgaagatcttggctgaaaagagaagacaggcccggctgcagaaggaacaggaggagcaagaacgactggagaaggaagaacaagataggtatgctagtgctcagaatttcggtgtgatctcatgtaactgttgtgttggaaagagcagcttgcctttctttttacagcgttggtattgataaaacttgaacagaagtatgggaacctagaatgtctgaactacatggaaggtgttcaggagactgagtcttatattagatgtaattattaataacaatggaactttgttcttttcggaggacctggaaactcatagctcttggatctaaatggcacaggcatcttcccattctcctcttggactttggggccaggcaggcctcctagagctatcagggaagtctgaactttgtttaaaaaatgagattctccctgggaaaacaagaggttcaagattctggttttggtcttgattctgatttccaaattgtttcctccgtcaaattatcctaactcacaccccaaagtgagagacagaggggagggttgagcagtgtcccctaggcatagggttgtgtgtaggggcaaccgcatagtctaagaacagtgaggtatggggagtcccatctgggagcaagacaaaagacatcattgcagtggtccctacaccttgaagagcatcagaatcatccggggaatgcagtaaaaacacatggactcagccctgttctgttttagtagcttgccagggtttgagaaccactgtgatgttagtaccagggtactttgtcacaatacagacagaccttccttttctgatctttttatttagagaggaaagcatgttgaaggacaaggtcgattttatcattaaattgataaaggaagccgttaggctcatcacagagtacaatccaatactgtttagagaattatcatgacaggaagcaggcaatgctgtagcacttcaaggccagcaccgaatttagagtaataaataatagaatattattgatcctttagtgaccttggtaagtctttgtggtctctgattacaggtttgctgatctattttttaaaagggacagtggggtaggtctcgacagtcccttcttgaaatttgggacttctttgattgttttcctgtttccaacattttggtcaatacagacgtgttttgtttgtttgtttgtttgttttgtcgagtggcatgtttgggctggtttgggtgggccttaaggtgtgtgaagggaggtcacaagagataaagatgaatcacaggacctcagatgacaggccttgataattgcaggccatggagataccatgtaggctctgagctggtgagtaacatgatcgtagtcgtgtgctaaagaaggtgatgttctttactttccagctaccaccgtctgtatctcccattttcttcacagcccagctcctgaaagacttgattgaacattctgtctttattttctcaactcacattcagtcttcaaacctcacacctaccactcctcctcgttgcctaactactaatcagtttcttggttggctttggccttgtcaagcttgcccttgcttctctggcctctccttcatagcctcctctgtctgcccctcatccccttaaatgttgcctgggctttcagcccttagtcctggaccagcttctctcccaacaagctctcccgaacagcactgctcccgcctgttctgccagtgtccctgccatcctgccagtttcctatggcgtcaaaagatttagggcccacattttacacaacagctttctgttgagcctttgttgtgctaaaccagctctgctctcatctcacttcccaccttcattttccctttgtcttgttttattgtccgtttctgaagctaactgcagcttgctttctaaaccttccatactttctggaacaagggaggcactaataacacatgtgtactgatgactcctaaaactatgcctgtggcccaagctctgtctagggctgcattgtccactatcagaccctctaggcacatgtggccaccaaaatatacattcagtaaaattcatttccccagccacacccgccacatttccgtgctcaagagctgcatctgagtagatgtggatccacaccacattgggcagcacaaatctatagattgttttcctactcaacagaaggttctattggatagcactggtctagaacctagagactgtatttccagctgcaataagttttcgtttgagtgtgtcccatatacatctcaaatccagcatttccaaagcagaacttagtattttttccccaaacttcccttctctttcatgagctctgtgttcccatctcctcagacacccaagtgaaaagtctcagtgctactctcagctctttcctttccttcttcttcccaatggttgtcaggtccagtcttcatcagctgtcacattggcatctctgttctctcccttcccttcccgtccctcctctccttcctcagctccagcccccatcgcttctcacctggactgtatctgttatatcccaactgagctccctgctctaggtctcctagagtttgtcccctgtccacgctgggcccacactgacctttctcaaataaatgtgattgttctcctgtcctttaacaagccagtgactcccctgcccactggatccacccgaacctgtcaacaggccttcaaggcctgccgtgaactgaccactacctgcctcttactccttgctttcctccagacaccagtgtgcaaagctccctgacattcacccatcacacggctccacacctccaaagctgtgcttttactttgcccccacgtggacttgtgctccttcctgccagacacctcttcatttctcaaaatgcaggtcaagtcttgctccctccctgtaccttttctggccctgtgcctgggacagaactgaccaccccccactcttcacccatactgagcccagctgttcagttgactaacatagcttcatttgtttacaggcctcctttccccagttagcaccttaaaaggctgggacatagtctttggatcactggtgcctggcgctcagtaaatgtacaagaaaggaacagaaggaggaagaatcctgactaagaaaccatcgtagtagtaggttaagagaacagaagggctaaagtagtatggtgaaggcagacatgcaaaagccagtctctgtggacttacacaatgccaaagaaatgggcagatttgaagttgatgctgaggtttgattctaaggtcttaggagaatggtacacccaataacaggtaaagaaaggacataaggaattggttttaaaagataaaaattattcatttgattttaggtgaggttatggtgtctacagtacgtccagatgattggagatggaattgaaggttgggggtgtaggtaaaaattagagcaatacactcgaccccaaatgagttttcctctctcttgccagaatgtgaagctttgcatagtgccacgtgggaggtgaggagtgaggaaggaaagtaccagacaacctggggctggaacacagcggccacctcttggaataagatcatcctcacatctgttttatgtttacagttaatagttaaagccacagaaatgttgccagataaaataatttagagaaaaataaagttacttgagtcaaaccgtggaaagcccaattattgtcacaaactggtaagggaaacaccatccaagtcaaggatgggggaaccagaacagaagggccaaccaggagtccagacaagcaggccctaagcagaagaacaaaagttggtccattcccaaacacaacagggcccagcccccaggctgtggatggcccaagatataaagtgagattcttagaggtggggcaggaaaccttagacgccgggtccaccctggggaaggcactggcaggaactagtaagcaggagatcttaatgggattcctagacggatcactttaagtcatgttaaaaagctaaaatagctactaggggttcacatgaaagaatattccagccagacgcaatggcttgtacctgtagtcccagctacttgaaaggctgaggtgggaggatcactagaggccaggagttcgagttgagcctgggcaacgtagagagaccccatctttttaaaaaattgaaggaaagagaatattccagttagacagctccctacgagcaaggtcacgtaggcaggctaaagtttcttgtcgaagcaagagttagcccaggccaggaaccacaggcagaggtcttcgaggctgctcagacctggctttttgctgctgagcctacaggtggcaggtggttttggtgagagctagggcaggtgggggcacatgcgatgtggggcagcaggatgtagcagcagctgaggcaggaagggaaagccaagagaggtaggagagagccagggtcatgcagccttatgtagcacagggctgtagggagagccacatgggcaggacttttgataagacataggcttatcaaagacgaaggctgttggtcttgggatttaggagatgaaaagagattttggagggaaattgttgagaagtaggatagagacaaagcagcctgaagagatgagtggatacaggcccagaatataagctggctgttaagcagtcatgaatgagaagcagctgagagaggactgaggagggttgcttgtgattcccgagacatgagcatttttccagggcatggaaaacatgcatgcagaaggttgaaactgacaaatgaagggaagaggggctagtgggagggacacatagctgtggaggatgtggaattcacagcacaagtggtggcatttccatctaagcagaggaacaaatggggacatttctgagcagtaatgtcatagaggagagtttaagaagctcagatcaggtggcctcagtcttctctgtatagcagttggtgataagcatcaactaaggaagatgacgaagattgagaaaagtggtaattgggactgtgtccataagggatccaggggatgaggattaaaaggccggaatgcaattgccagcaggcagataaccagccagcctcgtttacacctctctctaaccagtgattggcagcccaggagtggtcctggaaaccacccaagcctggagttgggcagcagagtgacctccatgccatctctgaaatgctcacaagggtacctaaggcctggggaacactgagagagagggaagcagacgcaagtagactgcacagcgctaaccagggcaggtcaggagagaaaaaggcagaaggatggggtgtgatcagatcaaagaagattaatgttgaaggttaggcttgttttaaaatgaaaacttttaagcacgtaagaatagagaccagtgaaacccacatactcgtccctcagattgaacaattcaagtttaagtttgtgtcagtgacatgaggaaggttaacagggagcgacagaaaagggggcgaggtgctggagtttccaacagacaggagccaatatatgaagatcctcctcaaatggccagtgacagggacaagggatgatgcatccactgaatgccaaatgatgacagtaatgcacagttttctggtactttgtacatagtgaggaaagggagagggacttgggtgaatgacaagaacaaggatggagagggtgacaggactacacacagggccaggcactggctcacacctgtaatcccagtgctttgggagaatggggtgggcggatcacttgagcccaggagtttgagaccagcctgggcaacaaaatgagacctgtctctattaaaaaaaaattcaaaaatgatccaggcatggtggcactcacccgtggtcctggctacttgggagctgaggtgggaggatcgcttgagcctgagaggttggggctgcagtaagctgtgatggcagcactgcactccaacttgggcaacagcacgaaaccctgcctctacaaagaaaaaaaaaaaaggactacacacagagctgatgaactttggaggtttagtaatgacggcaagggcggtaggctcggggtagcccacggcagagggcggtggggaaaatgatgaaatctaatgtgctgtctggttctttgagcagagacagaaggaatgctcatcctcggagaggattgtgagggacctggtttcacacaggggaagccagggttgtttgttttgttgaattttacctactttagggaagcaaagtgtggttaagggagagaacttggtatataagaggatgaaggggctgggcacagtggctcaaacctgtaatcccagcactttgggaggccaaggcaggcagatcacttgaggtcaggagttcgagaccagcctggccaacatggtgaaaccccatctctactaaaactacaaaaattagctgggcatagcggcgcatgcctgtagtcccggctacttgggaggctgaggcacaagaatcacttgaacccaggaggcagaggttgtagtgagccaagatcacaccactgtactccagcctgggcaacagagtgagactccatctcaaaaaaaaaaaaaaaaaaaaggacaagatttccctggaggtgctatggaaaggacaagcggggtctcatgggcttgtggggatttatattttgggtgataatgaggattatggaggttcaggggccataaggatgttcttacatgtgtgcatctgggcacttctgaagtcctgatggtaaaaaacaagaaacagaggccaagtgcagcggctcatgcctataatcctagcactttgggaggccgaggcaggcagatcacctgaggtcaggagtttgagaccagcctgaccaacatggtgaaaccccgtctctactaaaaatacaaaattagccagacatggtggcgcatacctgtaatcccagctagttgggaggctgaggcaggagaatcacttgcacctgggaggcagaggttgtggtgagccaaggttgcaccattgcactccaacctgggcaacaacagtgaaacgccatcaaaaaaaaaaaaaaaaaaaagagaatggattttcaggtcctggagatgaagacggcaggtcctttatgaagtagcttatacattaattaatacacaatgtatcctttgtgtgttaacttctctgggacaatcataattggctcgttaataaagggtaagaaatgaaatggtacttcagttaacctttagatacatcttgttattaacacatccattttggataatcctgtgttggacatagtatttcattgaggaatctaagaaaatgggagcttctttctgataggttctataatgctcctctccagaatatctgttaataatttgagttgtttcacaatggtttataggcattgtgacctaatttagtgttatcacgtattgttacagtctcaggctaatatatttaagtatttgtttatctttcttttaaaatatttctttgaatgaataaacaaaatatttcctttggtcatacataggctgttagcctgcacaagttctgaagctgaccattaggatggatggatgctctttttaagtcttgacctttttataacaacagcatcccagtaagtcattggcacatgcttccaaatgaaggtaatttctaaaggacatacagatttataggtgcactttaaaggacattggggcttggagagaggattcattttaaattgtaaaacaaactaacgtttgagaaccttctagggccaggcattttcattctcacagtaaagccatagaacaatagtatagcttttcccattttttaaatgggcatcaagaacattgagtgactttccaggtgtcacacagtgagtggcataatcagagtacaatttgagtcatgcccatacatcacattgccagtgattacccaaggaaagtgacgtacatgtgaggaggaggaacattagaaaggttaaaacaagctcttggactttacaggattttcccttactgcttcgagctctttaccattacaccatgaaccattcatctgactgtggatgaaaatgtctaaatgccacttaattttcatatagcaaagaaagctaaaatagatttctaaagattgccaaaataaatggaaatagaggttttaatttattaaatgtcaagtttctgttgagcattttcttccatttgctgcttcataagtcacataccaattagaaccaaattggtatgactttttgagttcgtagtcactgctcttaaattgctgactggcacatttgtggccattgagacacttcccatttttcctagctttcattggttttaaatattctgcttaggttttaaaagaattgtcattcaataagaatgatggcttggctttctgtcaccgtggtcatttgttcattgactgaggagcatctgttttcaatacagtatgcgttacacatcaacacatcattcattgctgtattacagaatttaaagtcaagcctggttaatactttttggtaaatatatggaccagagtggatttccaggaaggatgaatcatgttattaaatgaatgctcgttgaaaggtatgtgtgtgtgttaccatgtggagcattattctcggctgtcagcacacagttctctggcagtttgcttttcgagcatgtcatcttctaacaacagttgtattctcaaaaggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcaggtactgtatgagtcctcagatggactttacttgttttttaaggaccttgatagtaggtacaattagttaaatttcaatgactcataatgtttacttgaagtttcttcttaaactgtctgggctggttattaaatataagttggggcagttgcagtgaagttggtaatgtttgccatctgtgagttagggtttccccaaaggcaaaccctgggctaagaatttgagtgccagcagttttttttgcaagcgaatcccaggaagctggtagaggaataggagaaaagccaatgtaagtgcattgatgcatgtgttactgtgggtgactggaacacagtcccattgggaacctctgacagactgtggatcatgctttagaattgtccagctgagggatgaggaaactgaactacttatctaccacatcctgcccttcacggtagtagaaggtcactccctggggaattaactctctgatctggccacatgcacacttcatggcccaagcctgcccacagacacagaaaagccttggccatgtgtgagaactgtctgcaggtgatttgcatggtgagccaggggtatatgaatgaggtccaaccatgtttgctgtgtcatgcagtggtttgtataaatccacattgaatattggagcagcatccactttagggcagatgatgagatgaaggaacatgtgcaaagccagggaattaccacactgttttcttagcttattaaagctttgccttgatttacctgtttctgttagaaagaagcagcagaaacaaaggcccgggaggtagctgaacagatgcgtctcgagagagaacagattatgctgcagattgagcaggagagactggagagaaagaaggtaagggctgagggtcaggaagacctagggtaagtgaacaggaagtaaatccagttctcttctgcagtgattggatagaatgatcctaggattgtcagttaggtcaagttcattgataccactgttcaaatcttttatgtctttattagttttttgccatctcgttccatcagtgattgagaaagattgttaaaaactccatctgtagcgaggcatggtggctcacacctgtaatcccagcatttagggaggcagaggcgggaggatcacttgagcccagaagttccagaccagcttgagtaatacagtgaaaccctgtctctactaaaaatacaaaaaatagctgggtgtgatggcatgtgtctgtagtcccagctacgtaggaggttgaggtgggaagatgacctgaactcgggaagttaagcctgcagtgagccgagatcatgccactgcagtccagcctggggaacaggagtgagaccctgtcccaaataatagaaaaaagaataactccatctgtgattatggatttgtccatttttcctttcagttctgtcaggttttgttttatatatatttatcgtgatatgcctttgtctctagtgatatttcttgtcttaaagtctactttgacagccccctgccttttatttttttgagacagtctcactctattgcccatgctggagtgcagtggtgtgatctcggctcaccacaacctccacctcccaggttcaagcgattctcctgcctcagcctcccaactagctgggattacaggcgcacaccaccacacctggctaatttttgtatttttagtagagatgggatttcaccatgttggccaggctggtctcgaactcctggactcaagggatcctcctgcctcggccttccaaagtgctgggattatagacgtgagccactgtgcttggcctgacagcccttttatgattagtgtctgtatgtcaaatctttttcacccttctacttaaaacttcttctgtgtgtttttataagtaaagagcatatagccaggaattgttattttaattctgtttgacagtctttgtcttttaattggagtgtttagtccatttacactaactatacttatgggtaaaattgggtttaagcagactgattataaaggagtattctcatggtgtcctaggcccaacctgggctttgtattgctgtaggcctgggatccaggagaccagcctgtggccttctctcctgagatgcacctcagcctcagcctcactttctgtagggtggtgctctttaatggcaggtggtaatttgttgatttatacagagcctaaggagaagaaggagaaatatgggatataaatcgaatattgattctagatacgtactagttaacttctcaagcatttgaccttgtccatggggccggaggtgtacatctccaaaactagtggaaaacctttctatacttgttatcctcttctgacttttgccttttacaagttttctgagaaatgtgacattgcatgtaaaccaagctacttttatgtttttggtcttattgtcctcttacttgattttgttttttgttttttgtttttagagaatagatgaaatcatgaagagaacaaggaaaagtgatgtgtctccacaagtgaaggtaggaattcaaatgaccattttaatagtttatgtactaagtagaaaagaacagcagaatacactcagtgaaattgtaggtcttggcgacgattagccagaaaaaaatgcagttttcctgctttgttcctggctaggttaaggagggttaggtacctgaaaagaaagaggggcttcagaggtgggatgggtaagagatttccttagagtcatgggaggtgggatgaagagagaggcatagtagtccatgaataaaaaagagaatcctgacataaaaatacgtaagaataagggaaacacagctgaagatttaaagaattaccacagaacaggcagatggtccaggctcaaaatatcatcggatgcttttaaaaagtactttttttctgtgtgatgtcagccttccctcatttcattcaccttccatttgttttcagaaagaagaccccaaagtgggggtccagcctgctgtgtgtgtggaaaagaagacaaaactggttgtccccaacaaaatgggtgagtgtgacatctggttcttgggttcttccttttagtagcaaaagctcgtaagacttggtgtagggtaaacagacccatggatcccaagagggtgactgctggcaggggcctgtgcagtttcccttccctgggaatgtgtctccagcacagggactgtcagctccacttgggaacccactgggttccttggttactcccataatcccagcataggaggcactctggctgctggctcacagtgctttccagggagcttaactgctggtcaggttttattactgttaggacctgactctgctcttctccagaggttctgcacagacactgataatgtgatttgtcttctcttctcctgtgtgaaggtgattatatgggtttatttgtggctctttccacaaaagatgctgcagtatcagtgaagcagagcattaaattaattgccttgatctatatttctctgttactttatttagacattttatgattaacacaagggactttgtgttctcgatcagaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgaggtatattcatttcttttgcatttaagcctcatcacttctcgaaacactaccctttcttttagttggtttcttcgtcttttatacaaccaaatcacctaaagcaggtttgattgacattacaggaaagctctcagtggtataacattctagtgtcttgcgtcaggttccctagaagcagagcctggaacagagtttctagggcatgtgatttgttagaggaaagctcttgggagtttttcaggagaaaggggaaggagggaattcgctaagcaaggatgccttctcagctgaccccatgggagctctggaggatgaatttccaccagagacagttcctctgagcttctgcagttctggtttttctagattcttctctaagatctcacaaggaagaaaaagaagaacctggcagcagctttactctggctgttaagagattcctggtgacaggccctcagcccaccactcttcagagcctggatttgttcctttgctaggccttacagctggcgcaattatgaaactcctccttccatctctagggagaggaagagagagagagaaagaaaaccagccttggctgggctggagctggataagtcagagtggattggaagcctcactttagagaggaagcagagcgtgagattggctttgccagtgatgacgtgggctgtggtgggatcctttcattatgggccccccaaccttaactgagcacttcaggcgtttccacatgaactcttctcagcacgatcagattcacactcacaggagccctggcagagagaaacaattgttcccattttactggcgaagaaactgaggctgcaggaaggaaaagcaattcgcccaaggtggcactactagaaaggcagcactgggagccccactgttaattagggttcttcttcaacttgctttgaacttttggcattggctttctgtctgaatgtcccatttagaaagttctggaatgccttgcttctttgtggtagaatgctggtgcctgtgggtttttgtcctttcaccctttgggcaatgtgaccttggccatcacagccctgctcaatctgcttccctgttctcatacatggggcctcgtgtccaccatctgtcctcctcagatttgagcccacttgtattttttacagtgtgttacacaaaaactctgactctaaatccttcttctttagaagagtagtaaaacaaaatattgcaaatagaattaatatattgtgccatgttgtctgtctgtctctttctgcctctctccctctcgttcatctcttctagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtacagtcttttgattatattctaacttcataaccctttaactggggtttgtgaagataggatgtatatcactcagcctcttggatggtcaaattttatttgaaaaacgcaaacatgaatatattatggtatactacaacacacacaagaattgagacagatttcaattaattcatctgcgagccttcagcgccgagccgccttgtcctaaccctgctatttagggtgtgtagatgggaaagttgagaacactggctaaaggtttgactaccagtccagcctgagtagcttttttagggggcaaggaaagaatactctagtagtgttgcaaggtgatatgaataagatgaatttccccacctctagttttgctcagtgacatcccacattctatctagaatcattcatatacagggccacaggatttgctattctcttgacccattctggattcttccaaagcagacagctattcttggatcatacctgagggagagagaactgcagtttttgtgtcttgaaggttttttccccacctttggcctttttttatttttgccaaagtgcttccagaagctattctcatttgagcaagaatgtctatgagttatatacactctgtagtaaggtatacttagttacatatacctcacattttatttacttcagtttggggcttgtttttgaataaggaaaacataattagagtctgtcaccaaatcctttaataatttaataattccaattgctcctcccacttcagattctgtttttgttttcaagagaagtgatctcactctgttgtccaggctggtgtgcagtggcgcaatcacagctcactgagacttcaaactcctgggctcaggagatccccttgcctcagcctcctgagtagttggatcataggcacatgccaccaggcccagctaattttttttagtttttgtagaggttgggtcttgctatgttgcccggctggtcttgaacccctggcctcaagtgatcctctctccttggcctcccaagtacttactgggattacagccatgagctaccatgccttgcatccatttatccattttagattctttttttttttttttttttttttttgagatggaatctcactctgtcacccaggctggagtgcagtggcatgatctccactcacagccacttctacctcccaggttcaagccattctcctgcctcagcctcccgagtagctgggactacaggtgcacgccgccatgcctggctaattttttgtattttagtagagacagggtttcactgtgttgcccaagctggtctcgaactcctgagctcaggtaatctgcctgccttggcttcccaaagtgctaggattacaggcgtgagccaccgcgcccggccattttagattcttaaaagcatttttatattctcggcattttctcagtcactttattttttatacttcactcccataacaaattcactggccaaaataacagtccagtgtttttatttttcaaatgaggaaacaggtgggagaggctacagagctgaggtcactgtgttttttgtatacttgtttctacctgacctcagctcttgcctataagacaagtttgagagcccatttctcttggttcttggtgtgtggtgggtcacttttagagtaaactgtatcactggtttggaaaagcagctgccttcttggacacttaaaacactaaatcacctgagcattctatttccctgacagttacgtggcttaatatttattaagaggttttttgtgtttttaacatactttgactttaaaattagtttcccttcagttcacttacctcactatacagtaaggaacagagaatccacaaaatttattagagtattcataggtcctcaaatttatttcttacatctctaaaagaaatgcaaaacccctgtccaaaaagaaaaatctcaaattattttattcacactgcttgtatatttttaattatgattgggtctagttctcaaattcttctctaccaaaagtggtaccacccccaccaggagacgtttggacatacgttgatggtttttgttgccagagtggctgggggcatttgaaagacaaagcttgagacattaaatatctgcaggttttagaaaagttccatacaaggaaaatttgacccatctaaaagaatagtcctatgtaaaatactctatcacttctgttgagaaatactgtataagcccaggaggaaaatataattgccaagaaggtagaaagtgccacagtgtgttgtgatcgttttagtgagagaatagtgctacaaactgcacaatacttggttttccctttgatctcatctggttttgtttctgaattgacacaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctcca

SEQ ID NO: 3288 - DNA, 64595 bp, human
atcgcacgtgcacgccctgcgcgcgtgctgcgtgaggacgcgtgcgcatgcggacgcgcgcgggttcggtgcggcgcggcgggcttggcagtgcgcctgtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggtattatccccagagtgtggcgggcgcccgagggcttcgggttcctgtgggggggcgggcccggcggcccagggcaaaggtcctcgagcgtggggggaaggggcacggcgcagagctgagataaacgccctttccctggcccaggatcgtccggacgtgcatccaagggccgcacccctctctgtgcgagtggcggggttctttcttggggcgacctgggtgagtgggtacacatggggggtggcttagggtgggcggcaggtgtgtttgggatggaggtgcctgagggggtgctgcgggtccagtccccgtcctcgaggagcagccggcatgggggtcgttaggataaaccgagcggggttctggggttgccccggcctccgcgcgcgctctctctgcgttctgggaaacgcgcgcgagcgccgctgcagcccgcggcgaaggtggcccagcttcgcgcctcttggcgtttccagggggcaaaatcggcgtgtcacccattggcagaggcagattcgcccgggcggccaggcgtctgccccggaccgggtgctcctcccgcccggatgcgctccctgtcttgggaacgctgctcaggtggccgggccgcggccctcaatcgaggcagcggggcaaacaaggctctcagccctcgaggctgccgatgctgggagccatggagggctggtccctggctgcccagaagccagcgaggcagcggaggagactgtgaggacatttggcaggattttagataagcaggtctgatgctaacgttctgtaaagtggttgcaggtagtgcgggggtgtaagcagcatggaaaccgatttcatgctgtttttcctgacaacaacttttttatttttagttaataaggcaggctatttttaaaacattttttattgcagtctaatatgcatttaaaaaaccacacaaaactataattcgatgaattatcacatagtgaagatgggagtattttatatacgatgggccaagaaaaggaaagaaatcaagagaaatcttcttaaaacacgctttttcactggggttgagggggcgaggtagtattttctgactgggccttcagttgcatcattcttaggaggaggagatagcttaaatcatttccagtttgtatttttcattatgctattttaaaggcagaattcattaactgtcacaggataacgttataactacctttgaaatgtgtgcttttgtttttatcctttttgcttgaaacactcaagctgcatctgctagggaagaacctggaaactacccaccagaacgaccctccgtggcagaggcgaccttgtataataaaacactgaaaaggagaggttgtttcagtttgcatttttatttggttgagagcttaaataatagtttgtttcgatgttctgttgtactcatgagaggtggggaggggcggtatgattgggttttcagtgtatcttggattttatttgaaggaacttaaggggtttttttttttttttttttaatggaaacaaaattggggaaggggaggaggtacttttgcgggggagattcttaataagttctgtttggaaactattgtagaatcatttaatgcactcttctgatattaagattagcttaaggatatcttccttcatttgaaattggaaatatagaaaaatatgtgtgaaggtttaaaatgtgaaataagcacctatgtgcattaaggttggtatggtaaaattggaatgtttaatttaggtgccaggtgataccaccatttgttgtttgggggagttagcaaggccaggtacttaagtaaagtctccttagaaaaattatgattttgaggttttataattatctgtcctggatactgatcattcttggttacccaggcccttagcatttgggacccattcctaatgagacttaacctgcttttctagagagtcaaccattgttcctaagcttgggctgggtgctgtcaaggctgcaaaatacagaaagacctgagatgtttaggctgtccaacaattttgtgttgcacacttaggggatatgagttggcaagtggttttcctgggagctgtgtaaaagacggaaaggaaataccgctggtggtttcctctagcaacaggttcttccgatattgaaatcctgtgcatgttcccattaccccctagtgatgccttctttctttccttttaattacctctgaatagaaattaccagatctactgtccattttagtgcttgtctgatacacatagtataacaaatgagcaagtgcttgtttcaatctgcttaacaacctttaaccagcagatagaatcaccagatctcaaccatatttcctttctttctttttagatgaagtctcactctgttgtccatgctggagtgcagtggcacaatcttagctcactgcaacttctgcgccaccatgcccaggatcccagcactttgggaggccgaggcaggtggatcacttgaggtcaggagtttgagaccagtctggctaacatggtgaaaccctatctctactaaaaatacgaacattagccgggcctggtggcgcatgcttgtaatcgtagctacttgggaggctgaggcataggatcgcttgaacccaggaagcggaggttgcagtgagctgacctcgcgccactgtactccagcctgggtgacagagcgagactccgtctcgaaagaaaaacaaaatagggtggggcctggagatagagagtaggtggttattggagactgcgaagggtactggggggtgggaaggaggtaggaatggttaatgggtataaaaaaatagaatgaattaataaggcctggtatttgatagcacaacagggtaattatagtcaataataatttaattgttcatttaaaaataactactagtatgactggattgtttgtaacacaaaggataaatgcttgagggggatggctaacctgttttgcatgatatgattatttcatattgcatgcctgtaccaaaacatctcatgtaccccagaaatatatgcacctactacctactatgtagccacaaaaattaaaaattgtaaaataaaaaaaaaagtagagtgggcccgagtagcaaaggcattgggtccccaagaaatcggagttcttcatcctttttcaaagttgtgtttaaaaccattcttgaacgctttaatcctaaaactgttcagatcgctgggcgtggtggctcacgcctgtaatcccagcactttgggaggccgaggcgggcggatcacgaggtcaggagttcaagaccaggccggccaagatggtgaaaccctgtctctactaaaaatacaaaaattagccaggtatggtggcaggcacctgtaatcccagctactcgggaggctgaggcagggaattgcttgaacccgggaggcggaggttgcagtgagcagagattgagccactgcactccaccccgggcgacagagtgagactccgatcttaaaaaaaaaagtgttcagatcaagaagaacaagagaacaagttgagtttgtgcctctagagtctctttggtagtaggaaggaccacaaacttcctacaaagttgtatttggtttgtggctcctggctttttttactgatggcagcataggacttagacttagcaggaccttcaggacaaactgctgaaagtctttgtgatttctcttctcatatcctagccatggtgacatagctgctcaaagtctgtcatttctaacctgcttcctctccaacatgaaaggatgttttcctctcaggtgccccatcttctgcagtggctagtgttttaaaagaacactttgtcttcttgtaattacattgattgccttacaaaacagaaggattcacaaggttgatttgggcaggcgagagatggagatttctgggggctgttggtaaatatcctggtgggtcttgttgagaggatttgatgagatatattggctggtgatacaatgatactgcctggttttagggggctgttcatgtgctaagttggctcaggcggcagttccaagatttgaaaacttcccatggccctgccctccggtcccttttgaaaggaatttcaccagaagaaggaagagggggtagtagagggcagccgcccttagggagggagtgtccactgtccacctcacatctgagtcggccgcatttaaatatggagtttaccgtcttggcatctgaggctctgggtctgactaggccttgggatcccgcctcgtctgcctctgaggtcagtctgaatgcaagcccccatctgcttttctgttgggaagcatttgttttcctcttgcctaggaactttttctgtttttaaaagccttgtgactagcagagtttgggttgtcatttaagcgaaaggaaaacaggtatgagtgagccgcatgcatgcaaagcatttgaggcaacagcagtgatgccaaatgcctgagatccttggaatgacagggtctgtccccagggctcctagcttctgaccagtgctgggttcgttcaccacctaaaaagacttggcttttcctctcagtgccaaataggttggtgccttgtagcccccaggcaaccctttggaatgttccttgctcctttgtcatctcacccgcttcatccgtcccaccctctgtgtttctgtaataacagctttatggctggtcgtggtggttcacacctgtaatcctagcacttcaggaggctgaggcccacagatcgcttgcactcaggagttcaagaccagcctgggcaacatggcaaaaccctgtctccacaaaaaatacgaaaaattagctgggcgtgatggcacgtacctgtagtcccagctactttaggggctgaggcgggaagattgcttaagcccatgaggtcgaggctgcagtgaactgagattgtgccactgcactccagcctgggtgacaaagtgagagcctgactcaaaaataaaaataaacagctttatcatctgtataaaattcatatgccatatagtccacccatttaaaatgcacaattcgatggtttttagtatattcacagagttgtgcagccatcaccacaatcaattttagaacatgttcaccaccccacaaagaatccccatactcactgacattcttcattcccccggcctcacaactacccatctgtctatatagagaccacgagacttctgccgggacagtcttcagcctttggtgcagacacgcgttgcaattgcctagaagtctgtgggtgggtcttcatgcattagaggtttagaaaccaatattctgcatactctgtccttcaggtctaagacgcgcttttaccctgaagccttgccttttcacctcctgtacattcccactccacagggcctgcaaagcgctcagaacctgaatgtaatgtacacagcggtctgcagttatatactgcacatgttcattttagcttcccagacagtaatggccgctaattgttgagcacttatgtgccaaccctcatagttctgggggttgcctgggcttattggagaagttctgctgctccatttggggtcacctggagtccctcatgctggtacagtctgctggtctgctgggagctcagttgggctcgaaatgtccaagatggtctctcattgtccaggtacctaatcacagagagtctgtcctggactttctaacagcgtggctgctgtgctttgaataaggaagcagaagttgccagttctcttaaggcctgcacatagaagtcccagaatgtcatttttgctgtgttcagtggtcaaagcaagtcccaaggccagcctagattcaaggggagaggaaatagactccacctgttgatgtgagggcagcatgcacctactgggaaatgagaaattgttagtggcccttttggagaatatctactgtaataggcaagtacagtcgttccttggtatccatgggggatttgttccagcacctctcaagaacaccaaaaatcaaggatgcccaagtccctgatataaaatggtatagtatttgcgtgtaacctatgcacatcctcccttatactttttttttttttttttttttgagacagagtctcactttgtcacccaggctggagtacagtggcacgatctcagctcactgcagccttgacctcccaggttcaagcaatcctcccacctcaacccctccaaggagctgggactataggcatatacctctatgtctggctcatttttgtttttgttttggtttttttgagacagagtcttgctctgtcacccaggctggagtgcagtggtgcgatctctgctctctgcaacctcgcttcctgggttcaagtgattctcctgcctcatcctcccaagtagctgggactacaggcatgcactagcacgctcggctaattttttgtatttttagtagagatcgggtttcaccacgttggccaggctggtcttgaactcctgacctcaagtgatctgcccacctcagcctcccaaagtgctgggattacaggcgtgaaccaccgtgcccctccctcccttacactttaaatcatctctgggttactgataataaatgtaaatgctatgcaaatagttgctatactgtgtcgttgttttgggaataatgaccaaaaaaaaaaaaaaagtctgtgcaaccatccactttattttatctgaatatctgaatcttttctttttttttaagatggagtctcaccctcttgcccaggctggagtgcagtggtgcaatctcggctcactgcaaccactgcctcctgggttcaagtgattctcctgccttagcctcccaagtagctgagattacaggcctctgccaccacaaccggctaatttttgtatttttagtagagtcggggtttcaccatgttggccaggctggtctcgaactcctgacctcaggtgatccgcctcccaaagtgctgggattacaggcatgagccaccacgcccagccttaatctgaatatttttagtctgtggttggttgaatccttggatatgcaacccttgaatacagtgggctgattatatgttttaattaagaaaggttatgtattcagcgagaggtgagagattaaaaaaagaagaaaggttaagttatttgcccaagggcacacagtaagtggcaaaccaggcttcacacccaagtgtgtttgacttcggagctgagaaacttttttttttttttttttttttttgagacggagtcttgctctgttgcccaggctggagtgcagtggcatgatcttggctcactgcaacctccgcctcctgggttcaagcgattctcctgcctcagcctcccgagtagctgggactacaggcgtgcaccaccatgcccggctaatttttgtacttttagtaaagatggggttttaccatgttgtccgggctggtctcgaactcctgaccttatgatccacctgccttggcctcccaaagtgctgggattataggcgtgagccaccatgactgacccagagctgagaatttttaaccccccgtgccactgtgcctccacggatggataataaactcctttcgcgcatgagctgtgtctcccacatctgctatacccctctgaggatctagctcagtactatctagccacatcttacaaagatcttgtatgccttttacttagtacacagttgtttttctccccaaaggcgatggggatctcatttcttagaattacagcaaaaatgttattaaaatgcttagaggaagataagttccatttaatggaatttcctagtttaccaggaatgaaccccccatcctctctgtgcccacaattattgttaaggatctgaagatacccttaatcggcttcctgccttaggacactgtgttgggtatgattgaggttcttgctgttaactgtggtcattgctctagaaggaccctggaagattctctgatactctaggctagtgtgtctcaaactaactctggtaaaggagcagtttttagtttttttgtttttttttttttgtaaatttccaatctgctgttgaccagtatcttggtaaaacacagtaaagaaaaatatatgaaagacatggaaaatacaagtcccaatttttaaatatcaggttagattaatattagatttaaagagctcattaagtaacagaatactctgtccagttgctgtaaatgttctaaatgcatgccctcggtggggtgcagtggctcacacctgtaatcccagcactttgggaggctaaggcaggcagatgacttgaggtcaggagttcaagaccagcctgggcaatatggcgaaaccccgcctctactaaaaatacaaaaattagccagatgtggtggcgcatacctgtagtcccagttactcgggaagcggcggcacgagaatcgcttgaaccagggaggtggaggttgcagtgagctgaaatggcgccactgcactccagcctaggtgacagagtgagactctgtctcaaaaaaaaaaaaataaaataaaaaagaagcatgctctcaatttatgcctttattctttattgcagattgataatgaataataaagagattgtgctccctccccacagcccatcagggttaggctgctcagggtttcctgaagaaaaaaacaaacaaacaaaaaaaacgtaaaaaagagagactggcacctgtccacaggacacactttgaatagctctgccctgggccagtatttcccaaagggtatggtacataagagggttttagattgcatgtggacagacttatctttttaactttagattaatagttctgttgattcttcaatttattttaaaactacaactagtacatcatgctacagtttctgaatattttcagaatgagtaaaaagtgaaaaaactacaaaaactaagcgaaaataagtcaatttaaagaaaaagactatccactgggcctggcgtctaggaaaaaaattttaaaaataaaaagaccaaataatagaagtcagtgctggctaatacaaacagaatgctagccacatatgtaatcttaatttttctagtagacacattaagaaaaagaaacggtgaaattaatataatacaacttacttagtcaagtatgttccaaaatattatctttcagcatgtaattaattaattaattttggggggggcgggaaacagagtctctctctatcccccaggctggagtgcggtggcgtgatcttggctcactgcaacctctacctccccggttcaaacggttcttatgccttagcctcccaagtagctgggattataggcacatgccaccacgcctagctaatttttgtatttttagtagagacagggtttcaccatgttgtctaggctggtcttgaactcctgacctcaagtgatctgcctgccttggcctcccaaagtgctgggattacaggtttgagccaccgcgcccagccccttcatcctcttatgtaccaagttctctcccttaaccacactttccttccctaaagtaggtaaaatttggcaaaacaaccaaccaatcctggcttcccctgtgtgaaaccaggtccctcacaatcctctccaaggatgagcattccttctgtctctgctgaaagaaccagacagcacattagatttcatcattttccccaccgccctctgctgtgggctaccccgagcctaccgcccttgccgtcattactaaacctccaaagttcatcagctctgtgtgtagtcctttttttttttttctttgtagaggcagggtttcgcgctgttgcccaggttggagtgcagtgctgccatcacagctcactgcagccccaacctctcaggctcaagcgatcctcccacctcagctcccaagtagccaggaccacaggtgagtgccaccatgcctggatcatttttgaattttttttttaaatagagacaggtctcatgctgggattacaggcatgagccacctcacctagcctcagcatgtaattaatattaaacgttattaatgagatatctgacattcttttctttgcagcaagtctttgaaattccatgtctattttacacttctagtgtgtctccatttggactgtttgcgtttcacgtgctcaatagccaactgcggctagtggctactgtattgtacggcactgacctagagcatttccatcacgcagggagttttgtggtctacattgagtctcatggtgactaagtattcagtgtgatgactgtgctgtcaagtatggcgtgaagcacagtatgtgtgctgtggtagtgagtccagcttggatctcttcttcatgaatgtagaggaaatggaaacacactttgatggaatgggctcccccatatcaggcaaagcaggcccggattccccaggcttttgaagggatatcctgattttgctttccccagcctgggtgaagggagtgcaccaaggctgtgactagtgggtcctcacacagattattgtcttggggacctgatagactgtggaaaggggatggacttggctttgtgggaattattaagctgtcatcgaggaaaagtgctaaggtttgaatgtccattccaaaactcatgtcaaaattgccattgtgatggcattaagagatgggacctttaagaagtgagtaggccatggggctctgccctcatgagtggattattgttgatagtggattcggtttggcccccatttgctctctctgtatcatgggcttgcttgcccttttgccatgttttgatgcaagaagaaggccctcaccagatgccaagcagatgctgacaccaccagcatccagaattgtgagccaagtaaatttgtttgttataagttacccagtctgtggtattctgttatagccactgaaaacagactaagacagaaagcatggtattgaaaaaacatggaaccataactgtgggaggagagagctgtattagccagcttaggatctcctgggtttggtgttggggtcggggtcaggaatccctgctgctgggtagggtctgctgagtcgggattcaatgggctctgtgagattcgatctggtcatcttccccagctggtgtcatgtcttcctagtgccttgtccacagaagccacttgctgattctgaccaataggtactgattgactgttaggacagatgccctaactctgggaactacaccattaaacagggaagttccagtgtatctgggctggttctgcctccatctttctaggtttgatgtgaaagagctgccattagttacagatggccttagtggactgattacccagcacctgcttcagggcctgcaggatgaaccccttcccagaccagcttgtctccttcctgagcagttggtctgtcttcaccgttggtcactgattccttcagagttgactcttggtttagcaactcaaccagtgtggtactctggttgctgtggtagatgtatgggattaacgtccttttcagctccattttttatccctacccttgtttttctctttctctcctactttctgtatttatttctactgtattttatataagcaatcttaatcttttctggaaggagggagggagggcaggaaatgacctcgcagctggagtctcaccaggcacctgcagccctttattaagcagtgctctatgtccctgtttcagaacaacaccttaatatgtgctattaacttgaagtaaccgtctgaatcgtaaactgggcaaaaccgaattctgctgatgtgcttattcttaaaaacagccccccatgggattcctgtatgttctcttccttcaatacctagcgcgttttcagcactacatttaccagagggaaagtgtattgttcatggggatagcatcacctcttagcaggtgttgctcttttctaccctattaattgtatttgtttagttttcttgatcaccagtcaggggtgacagtgggtggtgaaatactgtgacagccttcagtggaagctttccttgtacctgggtaatttttcccctggtggagatacgtgttatgaataaaatttagcattgatcattttcattagctagataatcaatatttttaagcagttgtagttatgtctacagaccaaaagctcttttaaaaaaatcactaattctaggccaggcgtggtggctcatgcctgtaatcccagcactttgggaggccgagaggggtggatcacctgaggtcaggagttcgagaccagcctggccaacatggcgaaaccccctctctactaaaaatacaaaaattagccgggtgtggtggcgcacgcctgtaaccccatctactcgggaggctgaggcaggagaattgcttgaacctgggaggcagaggttgcagtgagctgagattgtgccactgtactccagcctgggctacatagcgagactctgtctcaaaaacatcataaactaaacattaaaaattatgcattttaattgccattttcttactgcaaaacatgttcctgctctccctttttcctctcctcacccacctaaatttccacttcacttgattttacttttgccagtcacaaatttttttctgaagaataattgcttcttattaatagtccattgagctccacatatccctaatcttctgggatgagattaaccctttttatagaagaacaattaagtgaggaaaatggactgtttcactataccctgttcaactttaatttctcttagttgtgttttagtttctctgtttcaaccaagaggcccaagggttctcagtgcctttctactggggagtgttgaatgtcctttgtggtacatagttttatctttactgcttaaaaatcaaaaggattatttacactttggcatgtaaagattatatcagagcaaatggctcttaattcaagcagagataagacatgcaaggtacaacactgtccagtagaactttctgtgatgttggaaatgttctaggtctgaactgttccatatgatggccactagccacatgtggctgttgagcattgaagacctgagtttttaattgtttctaaatttaaaaaaattgaatttatatcagcacatatagtagtagcttctgtattggactgtacaattaactagctgttgactaacctcgacagattaggatcaggaatgaggaaggagtttcagatctcaaacaaagttacttcaaacccacctactcttggtttctcctgtacaggctttgatatttggcacttgtcattcaaccactctcagatgctggtaggccaccaagaacagaaccagcagttagctccttgacactgtatcaggtctgtaggacagtgatcgaactggtagacaagacttgttcctggctccgtggtggccctggagtgcccacagtcagccaatcctctctgtcctgtctcagcttttcaacttggcacaactgaagagtaaaaactggagccagggtctttagtttcacaacttggttggagaaaccagattgacttacaagccattaccaaaccattagataaaaccagtagctagctatgcaggatttgggtgagctgtgggcagagcttttccagcaaaaggttggcagggacctcaaccacaccctaggccagagaaccccgtggcaggaagtgaggttggtgggggcattggatgcctttgctgagttaatcgtgttccctgttctctagcaagtactcagtaaaatggataagtctcagctctttcattctagcttgctccttacaaactgcggcctcagacattggcccctagaactcagttgcttgtctgtacaatgagattgtacacaaggtgatcttactggtgcgttccaactctgtgatgctgtgatcctccacagctggcctaggaagcagagggaagcatatggctgctatctacccttctcattagtgggatcaccagccacatagcttagaacgactcccccccaccccgcccattacagccaaacccgagggttctgccttctttatctctcatgaccgcatccccatggccagtgctttgggtcagactctgtcatctagagcctcaccagtatcagaagaaccttagggatctctgtccgtccgtccaggtcaccgtccctgtcatggatccttcatgtcattctcttgctttaatctcctctgacacttgcctagcacttcttaaagagtatattctaaactgctgttggagttttcaggcatgttggaatggggctccaatttacccctccacccccatctctctggcctgtaaccactcccgctcagaatgttcagcacactttgcacgtgactgcttgtgtacatgctgttctcttcacctggaattcttttcctctctgtgtctgccatcttcattcctgtctaccctgttcatctttcagtacttggctcacacctcacctcctctctgaagccttccccaaccacacacacttttgatggttttttcccttcttattcattttccattacagcattgattatgaaaatgcagataaaccatgtgcaaataaaactgggactggcacttggaaactaaagtacacaaatcttaagtgcacagtctgattatgtatacaaccatgtaacccacacccagatcaagatgttaaatactttcagtacccagaaggctccttcatgcctcctcctagtcaatacttctctcaaaggtaaccactgttctcacctcttttcactatagatttgctttgcttatttttaaattgtattaaaatagattcatttaggagatacttttttattgtgataaaatatatgtaacataaaatttactgttttagcaattttgaagtgtacagttcagtggcattaagtacattcatgttgttgtgcagccaccaccacaatccatctccagaactttttcatcaagtatatccttctttgtgtctctttttgttttcttttcacttgacattatgtctgcaagattcacctatgttgtcacaggtaccagtggttcatttctttttatttctgagtagtagtactttgtgtgactgtatcacaatttgttttatcaattctcttgctggatggacattgtttttttccagctttttattcttttgactaaaacttttatgagcgttatgcttgtgcagataccttgatgcccatacatttctgttgggtacatacctagaagtggaatgggatctgaaatgtcacttcatagattctatataaagagtgtttgtaacctcctgaatcaaaacacaagttccattctgcgagataaaatgatacatcacaaagcattttcacagttagcttgtttctagtttttatcgcttgatattcgattttttcttataggcctcaatgggctcagaaatgtcacctcgtagattctacaaaaagagtgtttccaacatggtaaatcaaaacacaggttccattctgtgataggataggcatgtcttcagcattagcggatattgccaaaccattttccaaagtggcttgtattcatttcttattgctgctataacagattatcacaaactttagtggcttaaagcaaaataaatgtattatctcaattccagacgtcagaagtcttaaaatcaaggtgtcagcagagcctttcaggatgtgctaagggagaatctgtttccttgtcctttccaacttctttttttgtttgtttgtttttttttttttttgagacggagttttactcttgttgcccaggctggagtgcagtggtgcgatctcggctcaccgcaacctccgcctcccgggatcaagcgattctcctgcctcagcctcctgagtggttggaattacaggcattcaccaccacacccagctaattttatatttttagtagagacagggtttctccatgttggtcaggctggtctcgaactcccgacctcaggtgatctgcctgtctcagcctcccaaagtgctgggattacagacttgagccaccacgcccggttgtcttttccagcttctagaggctgcctgcattccttggctcatggccccttcctccgtcttcaaggccagcatcatagcatcttccaatctctttctctcttgctccttcccctccctcccccccagctctacttccactgttacatctcttctctctaactcacctacctctgttgtgattaccttgggcctacttggaaaatcctggataatctccccatctcaagagccttaacttgatcacatctagaaaggtctttttgttatatgggatagcatattcacaggttctgggagctagaacatcgacagcttggggccaatattttgccagccacatggctgtaccattttgtattcccaccacagtgcatgagagttctagttcctctccatctttgtcagtacttggtatggtcagtcttttgaattgtagctatactggtggagatgtaggggcaagtccaaggctgccaccccaggcagtgcatcctcctttgctccagtgatagctttattgcaacttataagcattatattatgaatatgtatttacattcctctgtcttagccaaactaagcaccacttcatgagcaggctatatagtagttgatttaataaaaggtccttggatgcgaagaactgactgagggcagttttcagcagagcagggaagcagagctgaagatataaatgaaagcccatgcttccagtctcaactctgctcagcccccaggatctgagggaagtaggatttccctcaaataaaaataggagtagagcaaagaacctggcttccaccttctgcacactgttgtctttcccaagatagttaatctataagtgagtaatgccctagaaggaaatttgggccttgactcctatgggtgttggttggaaatgacttcactgtatatgtaaatgagaggaaaatacagttccagctggctactggggagtctgatcttggaccctttgcagggactcaggttttccttttccttggactctgctcatgtagcaacatactgcagcttcttacttacagaaggaaagactccaaggtaagtaatgctttcttgatctcagggaatgtctgtcatgtgtgtagacttaaacccaccttggaaacttgaggttggaatgtctgcagaaagtgaagccagagtagagatgaatttccaatgcccctggacacaggatggtgggcacagatgtcttcgtactagaaaagaatctcggaaggtgggattagtattagataaaaggcagacaggatgatggcttctttcgggagcatcctgatgcaaataagcactttctgggttctgtttcattccctagtttactttgctgggcacacacctggtttcatgagggctgtaaggtttctaggcttcattcttacctttctaggctgccgaggtgttagcagcattcctgcagcttggcattgctgtgacctgagagagagagagagagagagagagagagagagagagtataaacttgcagtgtggcagaggacttccttggccctcacaaggtcaaccaaaacctggctggttggtatttggatcaaaagggagtcggtctttgaagaaaagcattatctcaggataggaggtactgtgacaggcctgtgccagagttattggtccctgtttaaaaatgtactgacagtgtcacagctttagtaatttaataagtacatgtgtggttcacaggctgatctgaaacaagctggctgtgccagagtgggtcacacctggaccttgagtagtgtggatggcacacacaccatgagggttgggacagcctgaaccaaactgtggccgtgtgtttatggagtgctgctgacttcttagacatccacttatctctgcctgctgtgtttgagatgtggaaaatgtcaggtggcagcattcatgctgagaactgtccccctgggatttggactccctctttactcgctgccatccaggtctggaggtgatctcgagaaagaatatggggtgagctgtcctctgtaatcagatgggtgttcactttttccaggacaggcactggatctccgctcaacattctctggggctggaggggtacccttcacctcctgggtcaggaagctctttatgttgatagaaacatgtctcctcttgctacccgctcccccccccaccgtgtagagagcggacaaccccttggcatccttttcacagaacttctaagtctccataaatgtggggaccaagagcctttctgtggcctacaccacttccagttgtttaaaccctcctggtgtaactttttatttggagtttactcctgtgacattggtgtctctcttctctaactgtttgcacaaattgtccatagtgagccctttcatctcagttaagaatttcccacttaatctgatcacctactggcttggccactaactagctataggacctggccacaggttagtttcttggcctcttctttacctgtgaaatgggaacatatctgaaatacttcatggggttgacaggaggattgtgaagtgttgcatggaaagtgtttgtagtgcagtgtcttgcacagaggtagtactctgttaagtaggaggggagcttatcatccgtgtagccagtacgaggacctaggctggatgtctgtggacataaaaaagattttttgttatagtgtacacttatatcaatatagtcatattgatatatttatgtatggtctttgccttccagggaactagtaacctagtgagataggttgtctctaacttactgtaatccaagttgagcattgataagtaccataaatgaaaatagaaaaatggaccataaggctatagatgaacagttcattctggctgagagctggggtcagtttttgtgcatttatgagtcccaaaggcaagtgatttttttgggagggacagtcacttatactttggtggcccatggttagcaggacagcacttcccacctggaagtggcctctatctttggccacgttcttcagtttctgcatagaaatgacatttctttttctcccacctagtgcttaatttatgattgaaattcttgaagtatccagtgatgccctattcaggaggctgtccagccagtagcattcctttttattcgttgcctaatgcaacactgacagtagcgttcatttttctcttcctataagtatgtcaaagtctcttatcctaggtcctagttctcactgtcctaggtgagctttctcttcccactttgtgcagttagtatttttccacagacatagaagaagaaaagagcactcttgttttttggccccacccctctttggcacacactacttaggtgcttcaccccacacattggcccagagcttaagagaaggtcatctgactgtctggagctgtggaaactgcacatggcttttggcaagagaatcttgtggtgtgctataagtttttaagtttaagagtttacactctgcactggataatatggtaactaattccatgtgtggctacttaattaaaattaaataaaagtaacaattcagtttcttgattgcactaagccacatttcaagtgctccatagcccagttggatggcacagatatagaacacttctgtcattgcaaaaaattccatgggacagtgccggtctagggggttgccttatagttgtaggctactaataggaaagatagatgttcattcaggcttcagtggtttagattttcctcctgaatgacccaagttgaatgtctaagctttaaatctcatcaactaatgcaattaaaatattttaaccttcttaaatttgaatacaaaaagggtattcattttctgaagtcttttttgtgctgccgaattaccctgaagtagatagcaagtgtggattcttacaggtgaggaccttaatttgttttttattgtggtagaatatacataacataaaattcaccactttaaccattttaagtgtacaatttagtggcattaaatacattcacaatgttgtgtaaccattatcactatctgttttcagaactttctccatcatcccaaatacaacatatacccactaaataataacttccctttccacctccccccagtctactttctgtctccctgcatttgcctattctaggtacctcatataagtggaatcataaaaaatttatccaatgtactgactcatttcacttagcataatatcctcaaggttcattcgtgttgtatgtataagtagtatgtgtcagaatttcttttttttctttttttttttttttttttgagacaaggtcttgctctgtctcggagactggagtgcagtgatgtgatcatagttcactgcaacctcgaactcctgagctcaagtgatcctcccacctcagcctccccagtagctaggactattggcgtgcaccactgtgcctggctaattaaaaaaaaaaaaaaaaaaaggacagggtctccctatgttgcccaggctgatcttaactcctgaccttaagcaatcctcttgtcttagcctcccaaattgttgggattacaggtatgagccactgcacccagccagaatttcttttcttttcttttctttttttcttttttcctttttttttttttttttttttttttgaggaagagtcttgctctgttgcccaggctggagtgcagtggcacaatcttggcttacagcaacctccgtctcccggtatcaagtgattctcctgcctcggcctcccaagtagctgggattacaggtgcccaccaccatgcctggctaatttttttgtatttttagtagagatggggctttgccatgttggtcaggctggtcttggactcctgacctcaggtgatccacctgcctcagcctcccaaagtgctgagattacaggcgtgagcctctgcacccagacttcttttctttttaaggccaaataatatttctttgcatagatataccacattttgtttatccattcttttgttagtagacattggggttgcttcccccttttggctattgtgaataatgctgctgtgaacataggtgtgcatacatctatttgagtccctgcttcaattcttttggatatatacccaaaagtggaattactggatcatatagaaatgctatgtttgaccctgttttgtgccaggggagaagtggggagacagggtgggtcttgctctgttccccaggctgaagtgaactggtgcagtcgtagctcactgtagcctcacattcctgggcttaagttatcctcccacctcagcctccaaagtagctggaaaaacagtcacttgtcaccatactcagctaatttttaaattttttgtagagatgtggtctcactatgttgccaaggttggtctcgaattcctggcctcaaatgatcttcctgcctccacctcccaaagtgccgtgattacagacatgagccactgtgtgtggccttggccctgattgaaaaacaaacaaacaaacaaacaaacaaacaaaaccttaaaatcattgttgagatataactcacaataacataaatttcattcttgtaaagtgtacatacagcccagtcgttttaaatatattcacgaggtcatgcgatcatctccactagtcactgattttttttttttttagacagagtctcactctgttgcccaggctggaatgcagtggtatgatcttggctcactgcactgcctgggaaaacaggcgtgagctactgtgcccggcctagtcactgatttttatagcctcttaggactaaagggagagggagaatctagaaagtggcttgggtgcaaggaagggagctttcaggattatgtataatactcttaaaacaggatatttgttaatcctagcactttgcgaggccgaggcaagcagatcagttgaggtcaggagtttgagaccagcctggccaacatggtgaaatcccatctctactaaagatagaaaaattagctgggtgtggtggcacatgcctgtaatctcagctacttgggaggttgaggcaggagaattgcttgaacccaggaggcagaggttgcagtgagccaagatcgtgccactgcactccatcctgggcgacagagcaagactgtcaaaaaatatatatatatatacatatatatgtatatatatatatatatatatatatacatatatatatatatatatatatatacatatatatatatatatatatatatatatgtatgtattttttttattaccaattccttgaaacgtctcataatctttagcaacaatcctctgcccactgcgaggctttctgacctgaagtttagaaaggctcccctgctacctgacatattttcagctactcgtgaggccttgttttatggaacgggatgttgaagaacctcacaaatgggtcagactccccagcaatgctctggaagcctgcttctataggagcagacaggtgttcatgtgctataagctttgtcacatgcccttccctagcagggaactacttctgttccttctctggttctggtcctaaattctgaagctacttgcatttccaaacataaagcaagttgtttataataaatgccttaaatatttgattttcagattcatattgctctgctttggaacaaggaatacaactcctctgcttttgttattacaagccatttatacatataccagggtgctctggttttcacttgttctcatcctttagttgtggttttaatattttgtgctttggacatggttttattgtggttttcagatacatggccagttttcttttctttctttttttaatacgtcatacaattcacccctttaaagcgttcagttcagtggatttagcatattaagtcatgcaaccatcaccacaatcaattccagaatattttcatcaccacaaaaagaaatcccttacttgttttaccccaaccccctgccctaggccacccaactactaatctcagtctctatagatttttgaccagcgttcttgcattcttgtttaatggttattttttatttttatttttatttttttttgagatggagtctcactctgtcacccaggctggagtgcagtggcgcgatcatggctcgctacaacctctgcctcccgggttcaagcgattctcctgcctcagcctcctgagtagctccgactacaggtgcgtgccaccacgccaaactaatttttgtatttttagtagagacggggtttcaccatgttgaccaggcttgtcttggactcctgacctcaggtagtccttctgcctcagcctcccaaagtgctgggattacaggcgtgagccaccgcgcccaggctaatggtgactttcttcctctctaaattataatataagccaccacccttttttccgtctctgttccatttttgtcttttccccttccctccctcccctcttctgatattagcaggttagctctaaattctccttaattagctcccaaaccggatgaattggtggatgtggcacaactgcaggaattcatccaacaaaccagggatggacaaatagtgtgtttgagccctcgaacacccttccaagtcatctgccttcattctgtcactatgaggccagccttcttttcactggctgggaggctgtgggaactgcgagctaggccagcaagagagaactgggtggaagctggtctcagattgatcagtcacacagcctggggagcaatgaactgagatttcagtgtgtggcccatgtgagtgagtactgggacagaaatcaaatgcttgccttacaaatgtagtgtccagatgtataaattcagccactggatcctcctatcaacagaaacatttaatagtcaaattacagtttcaaaatcagtttacaaattacagtctgaaaatatcagtatttaacttgagaagcactgttactcgtacctggtacagagtcagaactcagtgaaacttcccctttgccctctgaagttttgctgaaaagtgaactcacaaaagacagattaattagagaaaaggcatacacattttattcacgtttatacagggagaaccatgagtgactacctacctccaacagggttcagaggctttatataccatcctggcaaaataagttataagacgggggaagaagaggaattctgttgagaggatcactagggagaataagtggacaagataacttgtatactatcttgtgaacgggtctttcaggtgtggttacattcctggtcttacaaggaggggaagaaaaaaataaatgttccttttggtgggtctggactttaggcacataaaggaacttcaacttcgtcctgctttgggagagacattggtagggggaggagggggaaggtcagagagaccttgaggcttcttcagttcagtacgtcaaagtgccatattttgggatatctgcttctgagccccaacactgttattaagaggccatattttattgtaagcctactgtatacaaggcacaggttaggttttgtgaaaaataagccaaagcttcttgaatggaattcaagccctatttatgttataatgtgcaggagtttagcaggttaacactggggaagcagagacttggtagcatccacattttgcttgtttctttagaaccatatattttattaaataaatttttataaaacaatgtgttaactgtagataccctcaacacaggaaaggtttggttaagcttagattcttgctgggaattgtagatattataatttcttgtggataatttaaaaaatttatcatttactattggccactggtagctttattcaaggcaaaccatcttgctcaaaacaaataaccttgaccaaaaaggtagccaggatcctatttagtctatctacagattgtttttggttaaaaagacatcagtgtttgttccatgccatatatgtatctcctgtttcattacatctccgtattgctgggaatgaaacgagtaccagcaggcccttgctgtggaattttctgagcgaggtcagagagaagcacagtgtacttttagaacaagatctgtcctgcctttttttgtattctggagtacacttggggagaaatagagtaagctgctgtttggggaagaagtttgggcttttgatttattttgaaggagtttaagaaatgctaccaccatgcctggctaatttttgtatttttagttgagaagagatttcaccatgttggccaggctggtcttgaacttatgacctcaggtgatccacccatctcggcctcccaaagtgctgggattacaggcgtgagccaccacacccagccaatactagttttttttattgctaaagagtgttctgggccgggcacggtggctcactcctacaatcccagcactttgggaggcagagacaggtggatcacctgaagtcaggagtttgagaccagcctggccaacatggtgaaaccccatctctagtaaaaatacaaaaattagctgggcatggtggtggccgcctgtaatcccagctactctggaggctgaggcaggagaatcgcttgaacctgggaggtggaggttgtagtgagctgagatcgcgccactgcactccagcctgggcaacaagagcaagactccatttccaaaaaaaaaaaaaaaagagtgttccactcacagtgaatataccacagtgtttttgctccattgctgttttatccattctttctttcttttttttttgtctaagatgaggtctcactctgtcacccagactggagtgccgtggctctacctgggctcattgtaatcttcgcctcccaggctcaagcagtcccacctcagccttctgagtagctgggaccatagtcacgtgccaccatgcctggctaagttttatccattctcttgctgatggatagttggactatttccggctttgagcaataatggataaagatgctgtgaacatgcatgtgcaaaccaccttgtggtcctgtgtttgctttatttctcttgggtaaatccctcagggcgggattgctgggtcatatgtatgttttaactgtggaaagaactgccaaatcttttcccaagtggttgtattcttttacaccctcacctgaagtgtatgaaagttctaactgctttgcacctttgccagtacttgctatagtcaatttttttgtgggatttaaattttttttgccattccagtatgtgtataatggtatgggtttctcattggttttaccttgcatttccctgatgattaaagatgttcaatattttttcatgtgttgattaccatgtgaagtgtttgttcacatttttttttttttttttttttttgagacagagtctcactctgtcgcccaggctggagtgcagacagggtttcgctatgttggccaggctggtctcgaactcctgacctcgtgatttgcttgccttggcctcccaaaagttctggaattacatgcgtgagccaccatgcccggccggattcggcaactaatttgtacatcttaaagctcctacaagtttatgacacattattatatggcagaaatagactaaaaataactttctgtgcaaaaatagttctggaagtcgtgtcacagggctcttggcccagcagggagccacttttaactagagctaaaagccagcattgtaaatagcatagaattgactgtaaagaggcaaaagggaatgttttgggatgatggaagtgttctaaaacttgattatgggggtagctgcaaggctatataaattcacagtggtcacttaaaatgggtgaactttacagtatgtaagttacacctcaagaaaactatagtaggaagaaagggagaagggggaacgagggaggagaggaaaggaaaaggaatagaaaagcaagcacaaatataggagggcattgttttgtaaaaacccatttcagctacagaaatatgtacattgtaaatatgtatttctaattgtggagttattaatgatctaaaacgttggaaagctcctgctccaagggaatgacatctagggcagtgctttgcaaacttgatgggaatcccctggggatcttcttataatgcatttcatattcaataggtctggggcagggactcagagtccacattttgaacaagtttcagctcatgctgacattgctggtctgtggacctcacttctgagtagcaaggactagggcataaattgaggctgagctattgagaatacacaaacttaatactgtcattgttggaagggtctttagaaaaatctagtacaatatttcccaaatggacatcatcatgagaaccttctaggggtacttattaaaaacacagattcctataatcaagacagtgtgatactggcataaggatagacaaacatatcaatagaagagactgcagagtccatatatgagtaattgaatatttgacaaaggtatcaagataatttaatggaaaaagaacagtcttttcagcaaatggtgctggaacaactgaatatccatatgcaaaaaatgacccgtgattgataccttgcatcatatataaaaattaactccaaaatagagctaaacctaaagccataaaacttctagaagaaaatacaggagaggccgagcacggtggctcacacctgtaaccctagcactgggagaccaaggcgggcaaatcacttgaggtcaggagttcgagaccagcctggccaacatggtgaaaccctgtctctactgaaaatacaaaaattagccagaaattgcttgaacccgagaggtggaggttgcagtgagccgagatcgtgccactgcactccagcctgggcaacagagcgagactctgcctcaaaaaaaaagaaagaaaagagaacacaggagaaaaccttcatcaccttgggataggcaaggacttcttagaacacaagaagctcaaattataaaagaaaaaaattgataaatcaaaccatcaaaaattaaatcttcttttcttcaaaagacaccattaaaattaaaaggcaaataagatgaggagaaaatattcacaataaaaatgtcagacaaagaactgtgtccaggctgggtgtggtaactcacacctgtaatcccaacactttgggaggctgaggtgggaggattgcttgagcccgggagtttgagaccagccagggcaagatggtaggaccctgtctctgcaaaaaaaaaaaaaaaaaaaaaaaaaaaaaaaaaaaaactgaaaattagctgggtgtggtggggtacacctgtagtcccagttaccagggaggctgagccagtaggatcccttgagcccaggaatttcaggtgacagtgagctatgatgatgtcatggcacactccagcctgggacacagagcgagactccgtctcaaaaaaaaaaaaaaagaaaactattgaccaaccttcttgtgaataaaatataagcaaataaaaacatcttgcagctcagcaagtaaccccaaaaatgtgcagatgtgaacagaggctgggcacagctcacacctgtaatcccagcactttgggaggccaatgcaggcagatcacttgaggtcagaagttcgaggccagcctggccaacatggtaaaaccctgtctctacaaaaaaatacaaaaaaaaaaaaaaattagccggacgtgatggtatgcacctgtaatcccaactattcaggaggctgaggcaggagaattgcgtgaacctgggaggcagaggttgcagtgacccgagatagcgccattgcactccagtccagtgacagtgtgagactccgtctcaaaaaaaaaaaaaaaaaaaaaaaaaaaaagaaaagaaattagttgctggatccataagttaaaagaattttgaccttcttaaactccccagttgacttgtgacatgtttttaagcctggacctgctatttgcttgtgtgttagaccatgatggttagcagagaggtaaaatgattttaaatattttactaagtaatagtcacatgtgtctgaaatactgtaatttctgaaaataaggctagatttgtgaagttttattgccaagacaggctctgaaaatctttccttaaatgaattagaagcccagagttgaatatgttgttttagtctgtttgtgttgctataaaataatgcccgaggctgggtaatttataaagagaagaggtttatttggctcatgattctgcagactgcaagaagcatctgcttctagtgagggcctcaggctacttccactcatggtggaaggggaaggggagttagcatgtgcacagaccacatgcagagatagaggaagagagagggaggaaaggcatgtgctgggctcttttttacatccagctctggagggactctcatgggaactaacagagcaagaactctcattaccacgagcatagcaccaaaccctcatgacccaaactcctcccacctggctttaccaccaatcttggggatgaaatgtcaacgtcagttatccagactatagcatatgtgttacaggtttctgttgtgaagtgaaatatattttcctttgtaaatcatgcctttaagacaaggccttgcctttcacctctaggcaactgtcactccccccaccaatgtgttattctggagtcagactgcctgagtttgcaatgcacctctgccacttaaccagttctgtgacctcaggaaagtgtcttaatgtctcagtttccccacctggaaaatgggtacaataatagtacttactgcatagatttgttaggataatcaaataagtgtagacatgtaaagtatttagggaggctgaggcaggagaattgcttgaacccaggaggcggaggttgcagtgagctgagatagcgccactgcactccagcctgggcaacagagcgagactgtctcagaaaaaaacaaaacaaaacaaaacaaaaaaacagcatttaggactgtgcccgacatgatcaatgttgattattatcatcatcattattattgctatcctcattatcattatttctctaaactggctgttgtcgaaatctcttattaagctattttccatgcctcccaaattctttaacaactaaacttatggcttttcccccaagtctcctgaggctgcttcctatttctgcacatttccgcatacgatgccaaccactgttctcctggcttcctgggccgaaaacttcagatctcctttgactctctcctccccacctccattcagttgcctatatgtgtagtgtctaccttttcatactagaattatcctttcctttccattcagattctaatcacctctcatctggattattcatttatcgtgtagctgaaatgggaccgtgtagctgaaatgggaccgtgtagctgaaatgggaggacagggttcccgtgggcccagccctggacccacctgtgtgggataggggacaggagcagctgggaagacaggattgggtgcgggacatggacatcagcagtgtgagggacaggataaggaaaggacagtgagaaggcggctctgagaaggaccggccacaccttagggcctgcctgtatttgaaatgcctttattagcttttgcatattcctcacagacatctctttgcatacaatgaaggtctttgggtgaattggatgaaatggcttgttaccagcttgaatgatcacttagaaaaaaactgcgcaggcctgcacggtggctcacacctgtaatcccagcactttgggaggctgaggcaggtggatcacttgaggtcaggagttcgagaccagcctggccaacatggtgaaaccccatgtctactaaaaatagaaaaattagctgggcatgttggcggatgcctgtaatcccagctacttgggaggctgaggcaggagaatcacttgaacctgggaggtggaggttgcagtgagccaagattgcaccactgcactccatcctgggcagcagagtgaggctttgtcacaaaaaaagaaaaaagaaaaaaacttgagaaaacattttaccctgttccttctctttatctttgtttcttacatttagtgaccatattggctatgtattgtgtgcatacaaccatcacgccctgtccttagcagagaactccaattttgaaacctcagaaggtggatactgtgctcgatgaaagtactcagtgccatattgatgagcggaatgttgggttaccttgggaacacagacgtccttccttgttactataaaaagggccacagtggctgtggttgtaaggcaacctacattttactgattctttatggtaaaaacgtgcctgtagggaaatgctgtatttttttaagaactttgatcagatacatcagacttccttttagtgctgatcaaatcaggtaaacccagttttcagtacttacgggtttttacaagtatcaaagctgtttccatccatccttcttctcctctttcctgtgcccacagtaagtaggcaggatatttgttgtaagactcaatatgaattgttttcaccaacagggattatgactaagagtataatttatactaatgtccttaggaggggacttatttgcctggtagggcctgtataggtcatatgaaggcagatggcgtgtgtttgacctcctcagggtggcctgttgagcagggttgcctggccaagtaagccttcccactccagattgtgaggcagctcaatgtgtttgcctcgcttgcaggttcctaccatggtttcactgtactgccatctgggaaaggaaggttggtgcagtttattccataataattaaaagccttaccactactaataaggcgtttagatacagccctactggccgggtgtggtagcttacacctgtaatcccagcactttgagaggctgaggcaggtagatagatcacttgaggtcaggagttcgagaccagcctggccaacatgtcaaaaccccatctctattaaaaattcaaaaattagctgggcgtggtggtgcgcacctgtaatcccagctactcgataggctgaggcaggagaattgcttgaaccagggaggcggaggttgcagtgagccgagattgtgccagtgcactccagcctgggcagtagagtgagactctgtctcaaaaagaaagaaagagagagagagagggagggagggagggaacaggaaggaagggagggagggtacagtcctacctaggggaacaaattatgcccattgatgctgtcaaacacctatcagaagtttactaattctctgcgattgaagaattattttattattgctaccatttttaacaaagccacccaaatgggaatcgtgtttattttctttatcgttttctgaggttttatattactaccgtatattgatgtggcatgaaccaaggtgtatacactgtgaagaaggtttttttattcgtcacatgcagtgtagcttactacagcaggcttccttacccttggcactactcacttttggggctggatgattctttttttttttttttttgtgagtcttgctctgttgaccaggcgggggtgcagcgatgcggtctcagctcactggaacctccgcctcccgggttcaagtgattctcctgcctcacactcccgagtagctgggattacaggcgcgtgtcaccacacctggctaatttttgtatttttggtagagacagagtttcaccatgttggccaggctggtctcgtacccctgacctcaagtgatccactcgtctcagcctcccaaagtgttgggattacaggcctgagccaagggctggatgattcttgtttgaggctgagggttgtcctgtgcactgtagaatgtttagcagcatccctgacctgtacccactagatgccagtagcacctccccaggagatattttggagtctcaaaatatctccagactttgccaagcactggggtacacagtctcccctggttgagaaccacagtattagaatgtaaggattgtgtagcttgctatttttaaaggcagtggtcatctgaagcactagttttcggtcagctataatagaaatgtatgtattgacctttaagtatgacagtttggctaacttaaaataatgtggtaaatccaaaacccgattgctgtgatgtgctagcatgcttaaatagcaacagcatattgctgttctttgatgatcgtttttacagatgaatggcaacacacaggatttgaaaatgcatatatcatttatttttatgttcctgaaatgaaaaggaaagaaatagtgacagccacaacagcccaggtaccatccatactcaggcatacctgtagtgcacatgggaaaagcacttttcctatgtgttattttggaatggcagtggccttttctgtggaatggccaaaagagaagcttgtacatgtccataaaccttgggaattctcccctgaaggcctcgttgttttacttttcacaaatctttcccagaaccaaatattcagttccacggtttaccttttcttttgtatcataatctgtagttttactattttcaaaatcaacttttaactactggcagcaataaattgaactttaagattcatggttcttttgttttccaaagagggttttagcagggatgcggttagaggctggaggtgggttagatagaggtaaatttaattgacaagctagagataactgcgaggctgtttaaaaggccaaccagactgccctgaacaatgttgaatgcggttacacattgtactctgcttttgtggtttaaaaataatctatctgtggccgggcgcagtggctcacgcctgtaatcccagcactttgggaggccaaggtgggcagatcacaaggtcaggagttcgagaccagtctggtcaatataatgaaaccccgtctctactaaaaatacaaaacattagccgggtgtggtggtgtgcacctgtaatcccagctacttgggaggctgaggcaggagaatggcatgaacccaggaggcggaggttgcagtgagccgagatcgcgccattgcactgcagccccgacaacagtgcgagactccgtctcaaaaaaaatacaaaaataataatctatttgtgccatgaagctgtttcctcaaggcctcaaagtgcccttgaagattgtccttgtttaagaattatgttgtggctggactgaggatgccagacgcacagatctgtaggcctaggatgggggtaactctgctgggcatgtttttcagagacaaatggaaatggaacaggggttctaactttcaaaatcatttttaacctgtctcccaattgttgtaataccaagagttttactctctaattaaaaaaatattttttgtagagacagggtcttggtatgttgcccaggctggtcttgaactcctggcctcaaacgatgctcccactttcttcctaagcactgggaatacaggcatgagccactgctcccagcccaaaagagtgattttttttcctagcccctttatttatcctttgcattttgttttaaaactaaggaatcttcttgaaacggaagccagctggtggtaggagcaggcctaagcactaccctgatgacttgcattgctcttcagtagccttgtcagtggcctctggactcagtggtgtaactgggaccatctcttctgtgggctggaattgccatgagctaagttggaatagcagggctaggagagcaagcagttcacattgggtagtttgtgctcagcagtgattaaagctcagatctgggccgggcgcggtgggttatgcctgtaatcccagtactttgggagtctgaggcgggctgatcacctaaggtcagaagtttgagaccagcctggccaacatggtgaaacttcgcctctactaaaaatacaaaaagctgagcgtggtggtgcacacctgtaatcccagctactcaggaggctgaagcacaagaatcccttgatcccaggaggcagaggttacagtgagctaggatcgtgccactgcattccagcctaggcgaccgagtgagactctgtctcaaaaaaaaaaaaaaaatcagatctgatgcccagtgagatggccaaggaagagttgtcagcctaggaagaaggggctgtcctcagggaaggggtctgaagggtcctgttaaccctgtaacagtgaggttggagggaccccaaacaaccacatacatgtaattgtgcagaaacagaaacaaggaatgaggacaatataatcagcttgagacaaagagcttgcagttggcttgctcatactcaagagtgcagcttgtcctatggtagggacctggggccttatgggcatctgggccaggagtgccatggagattggctggaaaggtctctggtgagcctttgggatccttttttctttctttttctttttagctatctccctataggaaggatgagactcttttacatcttttactttcatgttattaaacacacatacacatcaccatgaatagaaatcaaatgacattgctaatactggaaactccacaggtaatttctctttaccagtcattacctgctgggttctgtccacagtttaaaagagatatttgtacatttcttgtgctttgttgctgagaaaaagcaacaagcttctaagcaagagtcatttatccccgtgtcttggccctctttccagaagctcaaagcctttctgagtcttgtcttggattggtgagttgggagcttgtattttcacatgacacaaccctcattgagcaaccgcttctcctgatatgtaacctgaaagccagcctctgccccaccattacaggaaaatactggctgggttaggctgaggaataatgatgcctgacatttattgagcagtgcttgtgtagcgcatagtgtactgagcagttccctcttttccctcctcctgtttgcatcctttccctctcaattaatgctcctagtgatccagtgagtgggcgcgatctccatggggttagaacccaggctacctggctctggagcccctgctcccagggcactgtactcagctgccctctctgtacttgctgggggatgtgggggtgctcttcaagggtcattttgtctgcatgattggagccctttatcaggtgagactccagaagctcacgcaaaagccctgcatgtcagagcctctccatctctaaaggacctgaggccaagttcagatgcccagacctacatgccctgtccatggtagaaaactctacccttgctgccctgtccatgtttactgccttatctcattctagccccatttgcttgttggttttttgggatcaccttgtatagggtgggtagaatccacattcttgttgttgaagaacaggcatgcacaaaaaactgtgatgaacagaattacacagaaaggagagcatgaaggtggaggagagatgatcttgcaaccaccgcacagggaagaaggctgggaggacagacctcagcatagagtcacccgtattaccttagggagccctgagcttagctgtataggtttcttttaactagcaaatcatgctgtgaatagaatatgctgtgcatattggcttattttgaaattacatataattgtagaaacacaggaagctaggtaattcctgcctcccagatgaggatccagggtgggagctaagctttcatatcatggtgcccggtagataatcagttgagtttaatttttctagactatgtcttccttcgctacctttgagtttgctcatcttagcttctaagcaaactatcagcttggcagagaaagccttagaatgaaaactgtgacctcttaggaagttgtggggggtttcctggagtagttttatggggttcttgggaagactgaaatgattccaggatttggggcccagtggtcatctgccccaacttgttttgtctgtgttctcttctatcatcaggggaaaggagccaactgtgaatactcctgcatgccaagcattttcaaaaggtcttgcctctaccccataaccttgggatgtaggtagtaatgttcctattttatagaagaggaatttaaacctctgagatgttaaggaatttacccagtctcttgactaggatacagttgggcaggccacatggatggagccaagaagaagctctcagggccgagggggctgagctttatctatgaatggggagaaaatccaattgaggcagttttactgtagctgtagaaagaaccaggcctttggggcatttgtagctgggatctgatgtagactggagacagttaaaagcatgagaaagtcaggttaacagttaccctggaagataacagctgtcaaggaagagttcaggaccaacgaaccagcttcttagatttccttatcttctggtaaccagcaaggttaggcctttttgccatgctctttctcttcagccactgcctgggcctttgcaggtgacttcagttcccatgctggccctggcagaaggcatacctcctatttcccatgctgcccttggagtccaaatacaccccacttcttcacagggccacagtgaagatgtggttacctgggagttgccgggttattcttcatagctttgggcactaacaacatatggcaggtggtcagcactgaattttgccttttctgtttgttgctgtagttgttacagctttgaaaataggtataaattacatacactacaatgcacaaattttaagtctactgtttgatgagttttggcaaatatgtacactctcggggcctagcctacccaatgggtcccccactggaggcttggggcaagctgaagacattgctgatgtgaaaacaaggattaaagatcagggagggtcaggggctggttctagactgtggtagtagacatggtggtggtcaggtaatgagattaaggaatactcatgctttctggatactcaggacatatctcatttcagggccatatctaaaccagtaataatgatgataatactgttagctaatatttattaggcatttaatatgttctaagagctttgcatatattgttccttaagctccacattactctgtaacacaggtgctgtttaacagctgagaaaagtgaggctgagaagcttccccagaagtcacacttagtgtgtgctgagcagggatttaactgagctgggcagagcccactcctctttcttagcatcatccttcgtgcttcccagtaggaatagctaccattttctagatatctaggtctctctgtcagtgctccttccctttaggccctctcattattgagagtcaaccagactggcctcaaattcatgctttgctacttaatagctgtgtgactttggacagatttcttaacctctctgagtctcaatttcctcatctataaaatgggggtgcctcccacctcctaggagtattgtgagcattaaataatatttgtagagaataatgcctggccagaagtaggtgcttaggaactcatatttttagaaaaagacaatctagcccacaaatacgtgtacagtcctcaaaactaggcactgttgaattttataacttggcatgttgtcttttggttctggggagcttatttaccagattgagttactggcgcaggagttcctggggtggctgagtacatgtgtatgaatatagaataacatcatcatataccaccttcataattagtgtttgtgagatgtcatctctacgtactttttaaataagaaattacttattttgctgaagacaggatctctcatttctaccataaagggcgtgtgtctacatgtgtagacaaaaacaagcaaacaaacagtgattggtaactgatatactctttgcagaagatgagaaatgaagaggacatatacatgtttctagtataatttttgttggaaaagaatccttgccctagttttacactggcagtgttgtaatgtactctatcttatcacccccattaggaaaggtagcctgattgaggtttccaggtgtgtgtgcagaggccctccatagtggaaggtggagaacaataaataggagcatgtgcattagaatagccaacgcagaatagctggatttgttgagctcctattgtgtgctggatacagttaagcagtgcctatatctcatttaattctcactctatgataggttctactcttatctccattttatagaagaggaagcttagagcaggtcctgcggaactttcctgttttttttgttgttgtcgttgttgtttttttagacagagtcttattctgatgcccagggtggagtgcaatggtgcaactttggctcacggcaacctccacctcccaggttcaagcaattctcgtgcctcagcctctcgagtagctggtactatgtttatgccaccacacctggctaatttttatatttttagtagagacggggttttgccatgttagccaggctggtctcaaactcctgacctcaggtgatctgcccacctcggcctcccaaagtgctgggattacaggcgtgagtcactgtgcgcggctagaactcctgttgtaccttcttctgataaccgtgtgtagaggattttgtggcagaatggtgatgattacatgccaagttttggagtcgggggtcaggggagggatccattctcattattattatttgaccttgatgtcaaagtactatgcactttgtattgtttgggcttcgcccaattctacatttggtggggaaaatggcccttctcttagctgtgcaattgtgatttaagaaaatcatttaggaatcatttgaattgtttagtaataatcttacatgtctgcatttttctggaaaatgtaattcagttagctgttttaaaaggaaacctatgggaatttagtgggcatattttataaaaatctattaacggcgtagatttgtatatagtcttaaagtagttccctatttctccacttctttcttttcaaggactttttggcatctgtatacaatttttttttttttttgagactaagttttgctcttgttgcccaggctagagtgcagtggcgtgatcttggctcactgcaacctccacctcctgggttcaagagattctcctgcctcagcctcccaagtagctgggattacggtgcacgccaccacgcctaatttttgtatttttagtagagacggggttttgtcatgttggccgggctggtctcgaactcctgacctcaagtgatccacccgcctcagcctcccaaagtgctgggattacaggcatgagccactgcgcccggcctgtatacattttttaattgtctataccttttggatgtctataccttcatcctagtagtcagtagttattgaacttaattcctagttctagacttgcctcattcaaaagtatgaatcatgacatctttgaaaggggcacgttgcaaggaatgaattgggtgataatagtgacttattatcaccatttaagagaaaatttaagccagttcagaaaattatagcaggtaggaaatggattagatcattcattgtcagagcgtggtccctagactagcagcatcagcatcatctgggaatttattagaaatacaaattctcaggccccaccccagacctactaactcagaaattctaggggtagagcccagcaatcagtttttaataagccctctaatggattctgatgcacacgaaagcttgagaatcattggattagaaccctcccccacccaaaaaaatgctcggaagagttattaagctattgcaagaaatggcatcttcctgagagacaaatttaagttgaaaccacctggttctgctcttgtcagagatagaaaatggaataaatggccactgataggtctttgtaaccatatgattcccctgaggttagttcctgcctaggtatttgtttccaaaataagtatcccaaataaataccagaacttcatgtaatagtcgaagaaatagaattcagtagtcaaaagggattaaaagcaatttgtacatttactggagactagaaaagtgtcaaaagatgaattcctaatatgcagctttttgcctcgtcctctggctcccagtattatttgtgcacacacacactgacacacccacacactgtaccttccaagagtcacacaaaacccttccctcactcaattcctagtcagaactctccccagaaacagtccaacatggctcatggcttcctagtccctcatctctctttcacttccttctctcttttattccccccatcccccacccccatgcagcatatttttcccctttccagtgtcgattaatgaaaactgattcatttctcacagtcctggaaatctacccacatacattctccatctgtgtaatgaaagcccaataactgattcatattggatgggtagaatggaaaaagccaagaacataaagacagagttctctttctggtggagagagagatggagcagtctcatctctggttgaatggggcctcagagctgttccacctgaaatttcatgatttgggattttgaaagtgccaatcatacattaaattgactttttagggttttctttttttgcacattgtatgctggtatgattaaaccttcattttaacactgtttttgtttgtttgtttgtttgttttgagatggagtctcattctgtcacccaggctagagtgcagtggcacgatcttggctcactgtaacctccacctcccaggttcaagtgattctcctgcctcagcctcctgagtagcagggactacaggcacacaccaccacacccagctaattttttgtatttttttgtagtgacggggtttcaccatgttggccaggcttgtcttgaactcctgacctcaggtgattcacctgtctcagcctcccaaagtgccgggattacaggagtaaaccaccgcgcctggcctcattttaacactgttaagggttgttttgttgatgttctcagagtgcctttaatggttatgaatttcattttgaagaaaaattaggttgctacacaatttcgctgttggttttcatcaaaagtccattgtattaaagcactcatcctgagttatggagagaattgagatttagccctacactgaaagaaatttaaatgggaagtttagtgaccttatgggattgtaattggttttgaggttttaaatgaaaaatatgaggcgggagtatgtgatgctttccgaacaaaaacaatataccctcatgcaataatgaaaaaggttctagattctgtcagttgattttcagtttccacttgcaagattgaaaagttcaattggatttcaggctttattattttctagcatatttttgcataaatcattacccttgcctggaatttccaactcctgcctttcactgatctgaatctgaccccacctcctctctcccaggagagcagcagagtccagaagaaatcacactggattaaaagtcagagagataattagactcctcccacttaataggacattggatgggtgggtcacttgatgttttaaagtctccatttctttcttttttttttttttttgagacggagtttcactctcgttgcccaggctggagtgcaatggcgcagtcatggctcaccgcagcctccgcctcccagattcaagtgattctcctgcctcagcctcccaagtagctgggattacaggcatgtgccaccatgcccggctaatttttctatttttagtagatggggtttctccatgttggtcaggttggtctcgaactccagacctcaggtgatccgcccgcctcggcctctcaaagtgctgggattacaggcgtgagccaccgcgcccggccggtgggttattttctagattaaagaaatgggccgggtgcagtggctcacgcctgtaatcccagcactttaggaggctgaggcaggcggatcacgaggtcaggagatcgagactatcctggctaacacggtgaaaccccatctctactaaaacaaaaaattagccaggcgtggtggcgggcatctgtagtcccagctactcaggaggctgaggcaggagaatggtgtgaacctgggaggtggagcttgcagtaagccaagattgtgccactgcactccagcctgggtgacagagcgagactccatctcaaaaaaaaaaaaaaagaaaagaaaagaacccctctaaaaataatggccagcaacatttaatgagcatttattatacgggaagttcttcccacacatttcatgtaaccatcacagcagctgtttatcacaacacatttatcatttattggcagtttttttcatccccttttaaaaataaacactcatttttcttccaacttgctaacatttatttttgctccccagttttacaaagtataattaataacaaagctgttgggattgtgtgacaaagatactttatagaaatatatatgatttttacatactcacatgtaccacataggtttgcctttggaaccagatatatcatctagatatttgggatgaaaaggaaaaacaggcaacctagaagatttgggagaaggccgcagataagatcaactaggctctggattttaagccttgttgtggaacactccctgatgtggtttttggtattttgctttttttggggtgggggggagcactacaaattcttttattgcaatataatttactaataataacattaatcattttgaagtgtaatctggtggcattttgtacattcgcaatgttgtgaaactgtcaccactgcctaaaataccatcacattttcatcactcccaaaagaaatcttgaacccattagtagtgtttcacaatgtctcccatccccttcattccttttttatggctgaacattatttcattgtatggatgtataacgccatattatatttatccagtgtgatggttaatttttagtgtcaacttgactggattggggaatacctagagagctggtaaagcattatttttgtgtgtgtctgtgagagtgttttcagaggaaattggtgtgtgagtctgagtggactaggtgggggaagatccaccctcaacgtgggtgggatcctccaatcccctggaggccaagacagaacaaaaactgaggtgctcagtatatgttactgcttccccttcatgaacttgacatttcttgagtgcttactgtgcacaaaacactgtgctaggccctttgggggctacaagaagaaatggaacatagccctgcccttaagaagcttgtatcctgatggatggactggaaagggagggttggcgagagagggcatcgggagggtagagtttcctgtgcctgagggtggtgaatgagagagggaaggacccgaatgtgaagtaaagaggaaaaaggtctgtgagaatcagagcactgatggaattcaatggaaagattaatctgtgtgtgtgttgggggtggggctatggggagcagctcatggagtgccttcctttctttacccttgtattcctcccacaactctagcagaaaaatgggtacaaagatgccttaaaatgttggttgtttttatagacacttctggtatgaggttaaaatattctgcaaattgggaggtttccatcaatgggacataatattcgtggccctttgattcagcaactttttgagtccctcccagtctttagggtgccagagattcagagataagacaagagtttagaggacaagggtcaaatgaaaagacccaaagcctggcagggtggtgcacacctgtaatcacagcgactggagaggctgaggcaggaggattgcttgaggccaggagttaaagatcaaccaggggcagcatagtaagacccagtccccctgcccctgccttccacctccacggaaaacaaaacaaaacaaaacaaaacaaacagacctagacagtagcatgtaggacagtaacaaccttggcaaaggtaaacactgtggaggaatgtggcaggtgatcagtcattccttctgcagactgttttggggctcactctgctgagctctgtcatacagagagtagccacagggagggccctgccctgtagaatcaccataatctagaacactggttctcaaggtgtgggccctggaccagtagtgtcagcctcacctggaagcttgttagaaaggcagattctctggctcaccccagacttactccatcagaagttctggaggtgatgtccagcagtcattttcacaagccctccaggtggttctgatgcatgctcaagtgtggtgagcagtgggctaggacagttgtcaggtctggatgcacattagaatcacacgcggggcttttaaagcaacagtgcctaaaccacacctaagactgactagatcagaatctgaagggagacccaggcatctatatttttgaaagctctccaggtgattccattgtatagccaaagttgagaagcggtggtctccacatgcttaaacagatcatcacagtgcaaccaagagtgaccattaaggtgggaaacagtgcctgtgagtccacagagcagaggatgcctggcaaccccttgaagggatcaggatggctccccagaggaggtgaggacccttcattgtatttcctattggatgagctcttcattcctccttccctttttttctggacattgcagttgcacaaatctgagtgtgatcggaaaggttattttaaaattcatttaatgtgattaatttttcaaagttgaacacagctggcttccctttaaaactttgtattttgatagtggttcttaccatgaataattgactaatatcaggtcattaatattctataggagagtacttcaagctaataaaattcattttaaaattagtttttaaaaatgtgttcctgcagcccagggatagtaggatctcagtcaagtatgagattttatgcttttctgttaacataagatagttgtttgactgctcagtatccctgttttattccaatttttttgtaggaattaattgcccaggaaaagacctctgtttcagagttgcaagtttgcctggatgctgttgccctgggaaacattattgcatcaacagtggggaaggggtggctctgacatgggtgctctttgtccttctcctgggtagggcatctctgagagggtatcccctttaggtccttcccagggcttcacatttgggccagatttttttaaaaaataattaaacttttgtattttgaggtcattgtcaatccacacgcagctataagaaatattataggctgggtgcagtggctaatgcctgtaatcccaacattttgggaggctgaggcaggaggaccacttgaggccaggagttcaagatcagcctgggcaacatagtgagactgcatctctacaaataaataaataaataaataaataaataaataaataaataagaaaaaaattgccgaggccaggcgcggtggctcatgcctttaatcccagcactttgggaggccgaggtgggcagattacgaggtcaggagtttgagactagcttgaccaacatggtgaaaccccgtctctactaaaaatacaaaagttaaccaggcgtggtggcgcatgcctataatcccagctcctcaggaggctgaggcaggacaatcgcttgagcccgggaggcggaggttgcagtgagccaagatcgcaccactgcactccagcctgggcaacagagcgagactccgtctcaaaaagaaaaaagagaaagaaaagaaaaagccaagcatggtgacacatgcctgtagtcccagctacatgggaggctgaggtgagaggattgcttgggcccaggagttcgaggctgcagtgagctgattgtgccactgcactccagcctgggtgacagagtgaaaccctgtctcaaaaaaaaaaaaaaaaaaattacagagagagcccatgtaccctttacctggtttcccccagtggtagtatcctacaaaactatagaacagtatcacaactaaaatgttaccactgatacaatcaagacagagtacatttcatgatgccttttatagacatccacttccctcccacccctaccctctcaacccctggcaagcatgtaggcatggatctgttctccataagttcttatggagttcaaaggtaaaactgggtccctggttttaaaaaaagaaagagatggccatagactgtggctcatgcctgtaatctcagcactttaggaggctgaggcaggaagattgctttagcctaggagttccaacatcagcctgggcaacatagggagaccttgtctctactgaaaaataaaaaaattagccaggcatggtggcacatacctgtggttccagctacgtgggaggctgaggtgggaggatcacttaagcccaagagttggaggctgcagtgagcaatgatcgtgccactgtactccagtttgggcaaccaacagagtgatatcctgtctcaaaaagataaaaaaaagatgataaatgcacacaaatagggcacatggacaaaggatgattgggtaggaaagttagacattttaggatttcaggccatacataaagactttcttttggaactgaattcagcactgtattagtctattttcacactgctgataaagacatatccaagactgggaagaaaaggaggtttaattggacttagagttccaaatggctggggaggcctcagaatcatggagggaggcgaaaggcatttcttacatggcagcggcaagagaaaatgaggaagatgcaaacgcagaaataaaatcatcagatctcgtgagacttattcactaccatgagaacagtatggggaatactgcccccatgattgaaattatctcccaccagttccctcccacaacacctgggaattatgggagtacaattcaagatgagatttgggtggggacacagagccaaaccatatcaagcattacttcttggatacactgtgtctttagagggcatctcctggtgttagtgttcacagtaatctacctcaattcctctggtttaaatctggctgtgttttggtaataactggtttatttgttagaggccatggtttgtgctccagccctccttacctcggaatgagctcaagggctttttgacagcctttgggagaaacatgtagagtcagaaggtggaagctggagatgagttaatttggcttctcttggaatggatattctcaaaatgtttgctcaacaattaagcagaagaagcagatgctgtgtggaagaagctttactcatccagtaaatctcaatcccgactgaactcagacttccttatccacatgtgccccagagcagctagacgtgcagagagagaatcacaggagggagctgccaggcttctcactgcagggtggtaaccgccagccacatgtggctattaagcgcctaaagtgtgcccagtgtgactaaagaactgaactgtaactgtacttaattttgatatgaaatttaaatagccatgtatagctcatggctaccaaatgaacacagagattccacattgcccatgttgggctgtttgagtcactccacccctttcagtgggataaaactgaatttaaaaaagaaagagacggccatgcattgtggcatgagcaaggagaggccttacagcttcccccagggtcctctgtaaccccttccccacccagcatcagccctaaaacattgctgagcaaacattttcaaaccactagtgtgaggaggaagctgctaattagcctgcctggacaggagccacatctgtgtccagctgggccagcgcttggctcacagtactgcttacttcatactgctctaatgagtcacacttgacttctctttagatttgcaagctcattcttggggccaggttaagatttgttccctgcatgcatcacttcgttacagcactaagactaaggtgttacatttcttcccgtgccagggaagcagcacagaaaagcggtaactgagaatgtgggtcctttccgccagatgtgagagattaggaaaaaaaaatttaatggtttttaaagtgggtcctgaagccagtttcttgcattggaatctggcttcaagtgcctctgtttctacacctgtaagacaaggatcatcacagcacctctgtcatcatagggtggttgggctgagaaagtctgagcagtgcactttgtccttgggaactgctcagttattacctcttattatgatgatgctggtgatgatgactgtgagcatgataataaagattttctggaaagatgatttgaaggtgtgactctcatgtgtgtccatgagagggcagcctaaaatcatgcatgtctgtggaacaagcagcctctgtaaagcctcaaggtaatgtgggcagtttcaagtgtgtttggccctttttcttctctgtttttcttttttccctctgtttgaagagcgctttcagccattttcaggcttactttagatacggagcaggcccatgaacacctagagggcagcatgggcagtacagagctaggttcaggccctgcctgggtgggtgagtttgtgtaggtgccaatgagagcgtctgtctaggcgtcctaggcttttctttgtaacttttcacacagaactaattcttattaatcagactcttgaggtagacactagaacctgactgtgtttagagaaaaaagaaacttgattttctatgcttgttccccttccactaacttcacacctgcctctgagcattgtgtgcatgcattggtgccaccatgtaaggggacagtggccggagctgtatagacccagagttgcatcagccacacatggctctggaacacaccaggggagactgagttacagagagagcagaataagagtcctcaaaccatgtgggagcacagagcatcatagggctgggggacagtgggggtcttgaagatgggcagggtttaaacagatggagcagggtagaataaaggatggcatgagctagaaggtgcatgggagaaagggcagtgctgaggtaaagttgggaaaagagtttggagtcagattgcggggtggctggaatgagctgaggagttggcctttaaatttttgatgacgttcatattgttgatagtgtcataatgattaagagatgaccaaaaacaaaatgaagaatggcacttggatttttctagtacttatctcattttaatatccctgatatttaatctaggctgcaaaaccagatgtatgtggggaatcatgacaatccagtgtttgtcacgccatcccccttcctcattcccactgcctacactgtgggccaggccttcaggcctccctcctggacagcagcaggaacctccttagaagaagcacaggttgctgtggcagcaaggcacactatgatgccaacttgtgatgctcccagagaggaaggcacagatgctggggaagtgaacctggttatattaacatgaaagctgacttctaaagaatggtgtgcttctttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcaccactgcagtccgcagtccggcctgggcgacagagcgagactccgtctcaaaaaaaaaaaaaaaagaatggtgtgcttaaatattatatacataatatactgggtccagttgtaacagagtgcagtaaattatttgtaatcctaaaatgatcatgaagatccatttaatcttttgtttagaaagccctttagggttctgcaggggttggttggagatgaaaagctccagggatatttctcagacattttcggggaagttgtcatttgttccatcttatttgttgtagatatttggatgattctaagatactaagattgacattggcacaaacttggcagaaccaaaattgaacttgagtgttgtctttcatagtgctcacccaaggagctcatacgttggctcctttcagaaagtaggccgggcatggtggctcacacctgtaatcccagcactttgggaggccaaggtgggcgaatcatctgaggtcaggagtttgagactagcctggccaacatgatgaaaccccatctctactaaaaatacaaaaattagccatgcgtggttgcacgcacctgtaatcccagctactcgagaggctgaggcaggagaatcgcttgaacctgggaggcagaggttgcagtgagccaaggtcgcgccaccgcattccagcccaggcgacagagtgagactctgtctcaaaaaaaaaaaaaaaaaaaagtaaaatgttcagtgtctgtgtaatgagcagtattcaaaattttgtccatttttgtgcttctcctctcccccaggtggtcctgcttcaggcttgggagcctgactagacgaggcctagtgggcttctctgcacactgccaggcccgtctgtcacttactgtactttctgaccccttgtctgcctgggggcaaaggattaaggaaggggctttgtcctctggggctgatgttggcccaactacaggacagcttggcaggtgcatgcgaaagtggtagctgctgcccctcagctgtgtgtgtcatggagagtgacagattggacttcctttggttgaagtgatggagatggatgatgtgcacgtgcagtcagactcgggtgccatgcccagttgcctatagtacttagcagatagggaaagagtgaagaactgaaacataatctagttttctcctttgtaggcatggagggatttttgaaatcagatgagaggcagagattggccaaagaaagacgagaagaaagagaaaaatgtctgggtaagttatgcactttggctattttggtccaagggagtggagatatggtggtgtcttttctgaagattcttagaaatttgtgaatgaatgggaactaggacagttgctagatgaacatgaagaatcaggcgtgaacctacactgcaactggcatgttcacaaataggtaattttcagaatagttcactcggcaaacattgaacctctgctgtgttctagccactgtgttagggtctgcagttacgatattgaagaaagagaaacagtcgctgcccctgatctaaggaagtcctaacaccttcaagtgtcaactgtgtacactccctcaggttctctcttgggaatctaaaagggccatcctcaggagaactgagaaaatcagcacttgagtcattttatattttaggacagagagccctggttgagaaaggccgtcttgcctcttgcaggctgtagacagattagtgcagagtgttcttcacaggatgctgagggagatagcgtttccccattgcattgagacaaatgaggagctttcaggttcttctcttcttcactgcctcctgctggtcggtacaagcattgcctcctccagggaacccttccctgccttggctaggtggaattaagggccccttagtaaatgccttgagggtaaggcaaattttgttcgtgtgttttaccccctgacttagctcagtgtctggtgcttggtgcacacacagttaaactgcttttgaatgaacatagccttataagcatcattgctcaacctagcatatagtttagccattatgcacaagtttgacttaatgacagccgtcatagtcatagctcccacgtggggaggcacttactgtgaacttcacggtcatcatcttgttcaatcttaacaacactgtgatgtggcaaacatgactgtccccacatcgtagaggaggaaaccgaggcagagagatgatctagctaacatgcttagggttacccagctagtggcagaggtaccagaaccctttatctcaatcactgcatgctaggatcctaccaggctctttttagggctctgctcttgcttccttgtttttggtcttaatccaaactgcatgggatgctctggtaatgacacctctcttctactttccttccccagctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggtaaggcccaggtgcaccctccgccaccttccagccccctcagcaggctgctcagagtgcctgggcatcctgcccagctctggggtaggagagagacctgccgtgcaccttctccttggtggctcccatgccttctttcagcaacatgacatgaaactcgaagcagcactgacatagaaccgcagagacttatccattcaactcaggtgttaatttgctgtgtgatcttgggcaaactggttggcttctctgggccttgatttgtgtgtctgtgaagtgagggttggatttggcagtctccaatgcctcttttagtcataaccttttctgactctaagactcaaagggtccctggtggtctagtagataggggaaaaaaaaaaagactcagaggagattgtgggtagcggctgggtgaggtgaatctgaggattacagatgggagttcatgcctccagggcaggcacaaggccagaacaagagcttgtgaggttgagaacaatgtgatcctgtcagttgctactggcaaattagtctaccctcaaataccaagatgctaatatatttaaagtttaatgtagttcttcgctttaattgctctttccagttaccttttaaaaaagaaatggcacataattacccctacagagttctttattactaaattttgaaaatatatttagaaagcatatttggattatagattttcttcacgattatatttttaggaggtaataaaaaccttatgtcagttgatgataattttttattcataaggtataatgattcatcttttagtatgaacaatatagaggtttggtaatctccaaccctataggatatgaagatgtttgtacaaattcagtattttttaaaatctctgaacagttgcttatcactatatatatttaccccttccttcttttttttttaaagaacacatacgaaaacacacacatagtcagacccatctttgcccaagaagcaccctttcatggtgatttctttcctcctcttagaaaatgaggtctaagccagtgtcttagctatggttcaccgttattggctgcagtctgattgctgtgccttcatctgctcccagttcaaatgtcagctccaatgccagctctaccactgagcagctggtggccaggggcaagtcacatgcccctctaactctgtctccttagcccaaaacagaggtagttacaggaattaaaagaggtgacttttgtaaaagtgcccagcaaagcacctagcacagagtaatcgttcaggaatgttacattctgtttagttacttcagctgagcttggctaaagcaaggtcaagagggtgctacccacaaaagcttatgaaacagagtcagtagatgggaaaaagccacagtataataggctgttttggtaacttgggacagatttctcctttcctaacttctgtgttaagagttgctggactcacccattttcttcccatcctccattccttgatgacttagagcttgtcctcttcttccatgatctctccattttgaaagcttgtcactgctgcttccaggaaggggtactgtgaagtcacataagacacttcccatgctctgacatatgcattgtcactgggggctgcttttgaggcaatttctgtttataatttttctctacagaacattagtgctggaggcatgttaaattaagtagaacagctcccccttcttggaggtgagggagttttatgccatatggttggtcctgatgcagctgaatcttttgtggtttcccttctgggtaattttctatttgtgtgcttccttgcacccctaatgtggtggagggaagcaggaggctgcccgaccgacccttgtcagcccaagctgagcttggttccctcttctccctgggcacagcagggcagggctgagggctgggcctcctgtggttgtgtagcaacccaaggaaacagcagcctccttctgccacctgctcctgccctcagggtcccaggggacccaggtgtagcttagggacttgccacacacaggctggcttgttagctacattgggtcggtgctctgctggcacagaggcctttttggcattctcgtgggtgacatttagggagaagggatcagcctgcattacggaagcccctcttcaaaggaaaccctctgcactggcccctatgattcaaggggagctctgggagggctgcagcctgctcagtgcctggctgtggatgttctccattctcttctcagtgtcagattgaagtctttttttttttttttttttttttggtcatgttctgtctctgtcagccagagaaaagcctctgcaggaagatcattcatcctatgcaggccattttacttctctagcctgttggaaagtgtttgttgcccaccaaatcctgcctctctgggtctgatacttaggagctcatgagaggcctgttgaccccaccccagccctgccctggctctgtacccctatggttgccatgatgtcactcttgataacccctcatgtctgtgccagggcagaagtgggtaccaccaatggcctgtctctcagaggtcttaagagttggcagaggtcttaagagtagtcaggcctgtcccagggaggggtcccagggaggggtggggtggttctactgtccacttgacaccctgaccttaaactcattctcttgctggaggccacctactccttaagttcttagaaccttcacgtgccacacagctcccaggaaccaagctaccagaacaagttcctgtcacctgtgttagggctgacaacacagtatgccagcccattctcagggcagtatagcttcctgaccagtggccctggaaaattggatttggaaaagccaacttcatgttccttatgctaaacagaaaagagaaaggcctctttctctttctttctttctttctttctttctttctttctttctttctttctttctttctttctctctctctctctctcttttcttttcttttcttttctttcttttctgcacacatccctgctgaggaccgctgggggtgtgtccctgcagtgtcatccccagaacacatgtaatgggccgggcatggtggcttatgcctgtaatcccagcactttggggagccaaggcaggtggatcacctgaggtcaggagttcaagaccagcctggccaacatggtgaaaacccatctctactaaaaatacaaaaattagacagacttggtggtgctcacctgtaatcccagttacttaggaggctgaggtgagagaatcacttgaacctaggaggtggaggttgcagtgagcagagatcgcaccactgcactccagcctaggtgacaaagcaagactctgtctcaaaaaaaaaaaaaagaacacatataatggcagttgaaaaggcacagccaccccctaccacccattcctgccagagactgctgtctgagtaacagtgtctggaatgtgccctgctggcaacctttaatactgttcagccagttcagcggggtcaccttggtcgtgattctccaagttcatccagacagatctaaagccagacctcaaggcatcaagtgtgaggctcgctccttccttctttccttccttatctccctttccttcctttctatctttccttccttcctctctttccttccttctttttttccttccttctttccttccttccttcctatctatcctttcttccttcctgtctttcttccttcctatctttccttccttccttccttccttccttccttccacccttccttccttccttccttccttccttccttccttccacccttccactaagccctacctaatagaggagattctagggacgaggatttgccttgccctttccccatcctctgttgatcatcagatgatactcaggagaaccagaacttggcaggaattgcagtatgcagttctgatatttattaatactgtttttctaatgtgatggaactttctcatgctcactttctgttgctcagcctttcctctaaccagtggctcttgcttgggggtcccatgaccagcagcacctgggaacttgttagaaatgcagattctcagcaggctccaccccagacctattgactcagaaactctggggataaaccccaggattttaataattcctccaggggattctcctacctgatctctcagatttgagaactattgctctaaatggtcctgataagaatcttcctctttaaattcagattcacttagctttggttaaggacttactgcatactagtcattatcaaatagacttagagtgatctggtgatgtaggtaagctcatccccattttataggcaaggaaactgaagcccaggactgcaatgttagctcaaggtcacagggataaaaagtgtcaggcagaggtgggatttgaatccttacctcctgattccaaatctgagatcctttctgtttcgtcatatgaaggaacaaaaaggtacacacaaacacgaggcaatactgacctattcaggactaaccttaaataagacttgtgcactggacaagttttgttttctatatgtatgaatcaccccattctgactttttggggttccataaatcctcttctcttagaacttgcttatcatctatttctcatcatctctccaaaagtgggtgatacaaagtgagtgtgtctttctctcagggacaactgtgttttcatcggcctcctcaaggtctgaaggaatgaatctccagtggtgggatttggagcagctcagtggactggggatggatggcaggggtagtttttctagaggccattgaaaagtccaggggcaggtctggctttcagtgagcactcattcccttacaagggtgccccccagatagctgatcagtggtcaggctggttcagtgaagctcactattctttcttttcattggtcccctagtagagaagggaccactttgtgaggtccttctggcatgtaggaaatctaccgtaacccacccaatacttaattcactctaggatgaaaggtttcaacacttcagttaggtcattggttaaatactttacgttaaaccgtataatgaaatactattcagccccaatctcgagtggctgtacttcaggcatcacatggcagagaagttctcttccttccaagccccagcttttatcaggcagactgccagagttggccatcatcgtttaatgggccagggtcgtgaggactggactctgccaaggcatgcatactcacgattgtagagtctcaggccaaatacaagagcacagttaatagctaatacaaatctaagagttacaggaggtaaaaatccccctttctgcttacaggtccctggagaggcagtctcttagcaaagtgctattcagagaaaaattatgtagaggaggctgagatgtggagaagccagatcctcatctcatccctctggtatagacagaagggataaatccagatacctattaagtgacctttatatgtttctagtaagtgtgacataaaggagcctttcctgatctttaagtcatggttactcagttgatgatgtcctaaattaattttgcttctgtgtgtatttttttaagccatgacaattgtatctttttgttttagaatgggctatgattagcccagttcctggagcacctcggggttgggttttatgagggcaaaagggtgtcattataactgctagctcaggccttctccagtggagatagggagaggagttggtatttgcagtgtcacggaggtggtggggagtgcagaattagagcaccttcactgcagcagcaaggacaactttatgaaagtaacaatttgggtaatacaggagagtgtttttgataaatactgttacgagagaagccgaagcctaatggttgtttttctcttctggttaaaaattactgggttctgcctccctgcctcctccacctaagtaactctgggaacgcatggatgcttttttttttgtggccagaaggttctttactcttgcctcttgaaaattttgaaatatgcaatattatcccagattactatatagcagaaaagcgtcacactatgtaaaacagttggttcccctttaagaagttctaagatgaaaatgcagctttgcaaaatagatctcagtgtcatgtatcaccccaaaaactcaaattatatttgcattaaaattttctcaaagcaaaatgttttatgcttttaactagaaaggatgctcttggttctggagcagaattccagctctcctggttagggcaaaatgccttgagataggcctcaaggagttaatgcttattgggcattattcctagggcagcttctccccagggaggggaggggacaggacacacggtgtttaggttgagagccagtgctagcctagccgcattgtttactctccacctactcagaacacgctggtgtggcagagagagcacgtatgcctgggttttggatgctgagcacagaaagccccatttggtgactcacactgtgcactgaggcagcaggtagtgtggtggggctgggtagttaatcttgttaacacttgccttacacgaactgtgtaggaacggctggaggcgatgatgcgccggtccctggagcgcacacagcagctggagctgaaaaagaagtattcgtggggagcaccactggccattggacccggaggacatgatggtgagtgtagggttgcccctgtatttcaggtcctgggtgggaaataatggagcaggcaggggattatgggcaccactgggtgtctccaggatctgggggatgctttgcacagcttttcagaggcaccactttcagatgtgatgtttaaaactgccaagattcctacgcatgcatttgttatgaaggggatctgtgcattcttcttgatagcaaacagcagttgacacaaaaactgggttttgagggagagcaaaagagaagactttgaacgcagagcccagtgagctgggcccagctggcaagcccagggttgttctgacttcaggggagggaaacggcaggaggctctgtcactggtccagatgcgatcaggaaaagcacagtggcagttatcctccaaaaagggctggactatttcctgctgcattttaaatttttgttgctttttcgactttgtttcaaggtgacttatttcattaccagttcaaactcatctttaaattttcaaatgtgtaatttaatatatggattgttactagtctctggatggcttttccttcttttcagtgtctcactacatttcagcgatcttagcattctattatgcaggaggtgtgtactagctctatctgagagcaaatggatttgtgtttacaggacagttcttgactttgctgtattgtgcttttcacctttgggcagtaaatatactttattttttcttttttgaaaagtcaacaacccatttcagttactttttctaatttcctaattagaaactaagaagcaacaagaaattgggacttttttcttttacctctctttgctctgattttttgctgtgtaggtgaatcagaaaataccccaccccctcctctaggtttagcagccagcaccctccctccggatgcagggaccactgccgcagctgccgagtccaccaacggtatatccgagcatcactgtgccatagcattttgtgataactgttctgatcatcctcccccatcaccatgtctgcgtcaagcacttttacaattggtttcttagtctggcctgtcacaatttttttttcctagcaatgtgaatgacatgcccatatttctttgttcctctgtcattatagagcggtgcatgccttacatcttagtgccccggagacatttcatcctcaactcactaacgtctgccttgaaaatcttgtcagtgttggatttttgcacactcagatctttaacaatctcttcatcatctgttgtagacattaagaagcagggcatttctgattacttctggttaccaaaacctgtaatcacccggagttctgaatggagaacttgggcttagtgttaaagtgatagattcctggagaggtgtttgagagggagtggtaggaattttatcagtgctaacactggtaatccaaataattagataatttggctttgtgcttgattttatttaataggctgtctgttttgtatacaggcctgggaaactcctctggtctagatcaagaacagaactagccaaactttgtttccatttaataatgactttagaaattcaatccatcttcaactggcaaagaaaaaaaaaaaaagctgtaaaagggatgcaatatttaccaacaatgcggaaggtcatattagcagtaggaatcaatatccttggtttctgacattcctttgacaatgaataatccttactgggggtgcttcgtaacagcagttttgctgcacaagcagagttacctctagtgtgggcactggctttccccctaagaaaggtgcaggggggctgggcgtggtggcttgtgcctgtaatcccagcactttgggaggctgaggcaggcggattgcttgatgtcagtagttcgagaccagcctggccaacatggtaaaaccccgcctctactaaaaatacaaaaattagtcaagtgtggtggcgggtgcctggagccccagctactcaggaggctgaggcaagagaattgcttgaacccgggaggcagaggttgcagtgagatcgtaccagtgccctccagcctgggcaacggagcaagactctgtcttgaaaaaaaaagaaaaaagaaaggtgcagagaggtggagtaatcacccactgggaatcagcacccagggcccgggccagggtgaaatgagtgcagtacttgactagagcatacaatttaagggagtgccaaaaatctcagtaataaagataaaataatatcttaatgtgatattttttaaaatccaaattaatgcaaaacaatccataataaacaacaaatttctaaagactggtgccatgctgagcacatcagagcctgaagcaaaagggaaaatgtgtactcctatatacgtggttttatgtaatttctaatgtttagttttatcaaaacattaaagtagtttaaaatatggaaaaattgaaaagagtattaaaactcatataatttcaactttaaatagttttatttctacacaaatcaaatttattgtacttttacttcagctttagttaattaaaaattaccgggccaggtgcagtggctcacgcctgtaatcccagcactttgggaggctgaggcagatcacgaggtcaagagatcgagaccatcctggccaacatggtgaaacactgtctctactaaaaatacaaaaattagctgggcgtggtggcatgcacctgtagtcccagctactcaggaggttgaggcaggagaatcacttgaacccgggaggcggaggttgcagtgagccgagatcgtgccactgcactctagcctgggagacagagcaagactctgtctcaaaaaaaaaattatttaagattgtcatttggtcagcagaaattatagaacatcgcagttcttatggcagttctcatgggaaaacacgatgagcagaggagtagattttgaaaatattattgatgagtttgcttttttacaaccaagagcacacatttttcttttggcctcaggctctaacttagcttggcagggcactgtcagcatctctttgtttgccgtctgaaataatgactggaacgtaagaacaccaaactcagggtcgcctgttaaaatgctaacctcaaacagttaaagcatttgcaaaaggaccattttgatctgtctcttactaagtaagaaaaggaaaaccaactgctaaagaggccgttctgctttaaatacaactctgagaggacggatttcatctctctccaacctgagctacagataaccttcataaaagagtcggtttcagcaagcggtgacagtcagaccatagggcgttttccagtggtgatttgtctctgggtccaagttggttttgtttttgtgtgatgtgagcatgctcaaaaatccctagacaaaagaaaatgatttgttggtgggattaacacggcttcagttgaacagttgagtgaggttgaacatttgaaattgaagatgacaacacagtgaagaagttgcagagattttgctgcagaccaagggctgctgtagcctggtcatttctagagtaggataatgagatgccaggatgatgaaagcagagcatgctgtgccacagcatttaggaggtgcgtggatgaggacaggaaggacacttcgggatatgtgtttcttggttctacagtagtgtgatgaataccaatgtctttaatgcatttctctgcagcatgtgacaaactttcaacatcaactatgagtttgccaaagccaacggagcctcccatgaataaacgcctgtcttcatccaccgtggcaatatcctattccccagaccgaggcaagtgaacatgtagacttggtctctctagtttgtttcttttctggtgtgagcatcttaacgtttgtctttgtgagagtctcctcttgagccttctgcagataccgtcattgtcctagtcttgtggtctgaatgtgggagctctagggccttgtcagtgggactttggaacgtggcacggctctttagagccaggtcgttgttgaatagaggtaggaattaatgcagtctcccagtctgaaagagactgttctgttttccacattgcatgtaggagttatcctgcccaggaattaattaaccagtgggcagatgtgaccattaaagtaactgcctggtcaatgatggaatacagttgattagccagaaagagcagaattgataagttatagttatatgggaggcttagatatgtgaaaaaatggggttctgcagtcatctgtggtttataggcctgcccattttgtagatgaaaa

SEQ ID NO: 3289 - DNA, 110281 bp, human; identical to SEQ ID NO: 3281

SEQ ID NO: 3290 - DNA, 108582 bp, human; identical to SEQ ID NO: 3282

SEQ ID NO: 3291 - DNA, 110281 bp, human; identical to SEQ ID NO: 3281

SEQ ID NO: 3292 - DNA, 110185 bp, human; identical to SEQ ID NO: 3285

SEQ ID NO: 3293 - DNA, 109923 bp, human; identical to SEQ ID NO: 3286

SEQ ID NO: 3294 - DNA, 218868 bp, human
agggactcacacactgaaagaatatctttgatgaagacaattcaggcaagcagaatgattcttgcaacagaattacatgattaattgagatcttgaagtgggtccggtgaatcctggccacctaacttatcatgatttgggggagtttcacgagaatccagttttgataaaacaattgtttttttcctccccaagtgactatacatttaaatagctaaaacatctgttcagcaacatagtaaaacatatatactcggaacgcttgagagaagagcctgccaaacagggactttgctgagggagagcaccaagataaagcaacactgtttgttttgtctagtcagggggaaagccaaggcaaccaatattttggtttttataattttcatttgtgaagaattatttgagaaagggtggcgaggggagatttcctgacggcagtttcttaagctgtccattagtagaagagcaagaaagccttggatgtcaacgcctcgctcttgagaccagccaccaaaccacgaaaagtgactttcttctcgtgtgctctctacggcccttctgatggaagcagaaacagggagcagcgtggagactggaaagaaggccaacagaggcactcgaattgccctggtcgtgtttgtcggtggcaccctagttctgggcacgatcctctttctaggtaagtggagtgcaggaggccgggggaactgggtgtgtgtcgagaagtttccttgtgctttattgtagcaaaacttgtcataacacaggtatagggctgtttgcctgcgttcataggtggtgtatctttagtttctatcaaatatgcaaatgataaagaaggcttttttaaggagcctaaataaataaatacacccaagtaccaaatgtatagtccagaaggcaaagtgggtgtaagtggcttcgagtggctggctgattctgttgcattgggtggaaaattttttatgtggtacatttagcaaaatgagtgtttgtgaattcatagtcacatagtttcatttatattttgaggaaagactttacattgtgatgaaaaccatgctggagtgtctttccatttgacttttattaatgtttgcttgaacgaatcatgaaatttaattcacaaaacacaaatcagtcctttaaagtgtgcttttaatgatattcttcaattcctttcttatccagtgactctggtgagatgcaatttgatttacaaattaatatgaaggaaaacagaggttttcccccaagatttgaaagatattgtgattcagttattttaatgactgttggtgagaatgatgtacccagagagtatataggatgatagaagtgtattcccatgaaaaagaatcaaatatcttggaaaggagtgagggattttctaaaattctaggctttctgaacccttgactattaccgttttaatttttctcatacaacccataatacttcattaacttgaacgttacataggaacgaggagattctaggtgcagtttgaaatgtagcaaacctgcaggaggccatgtttattttggcaggggtaaaccagtaattaaactttaaaagagttagggttgtgtggttgaaaactgctaaaatgagcaaaccatctttccacgctttctgtggctgaagatttaggaaattagatgggtttattgctttctgataaagcgaaatctcctactcctgcaactgaatctgtggctcttgaaaactcttgtaagatttctcagcacttagggtttaaacaagggtcctctgctgaaattccaaacaagaggaaaaattctatgggcatgccaaaagactacaggctacgtgcaacgtgactgcaaggttaggttttgcaaatgctcccaaacttaaaaatcccaataattattgtttatgtaaaaatatgtactctttttaacgatattaccactgcacgaaacttttacaaaactctacttttatgattacctcctgaggccgtggcatatcggttgaaagattctccgcggcagcaaatctttgttctttcagagaaaattattctcaggaaatagtgccgatgtttttagagcaaagtaaaattcatcaagccagacgctactattatggataaggaggcctgcataaaatatgaaagagaactttccagcgtgcccaataacctggctctcaccttgactctctaagaggagctcaaatgatgttagagaataagggcaaactgaggctgtggcctctacaactttgcttctcaaaatggggtctgtggaccagcagcattagcatcactggggagcttgagctccaccccagacccgctgattcacaatctgcattttcacaagacccccaggggactgtttgcaaatgcaggtttgagaagcattgcttcaggtgaccatatctatttggatgtatacattcagggacacttctttttgtcaaatatttctgcactattttagaatcacccccttaccccctctccccgtccctctcctcaactctgccacccacctccactctgcacccaggcaaagtgcttgtctgaaaagctccagggacctgcctggcaatgctcttcatgacaatattctagttagggtcgtcgtctcttcaaggggcttcctgcttgactttgtggtatatttctctgcctgtccacattcacttacatgcctgcaatttctagcatcccttcgtacctcatctttgtatctgaggctctgggataatctctcctcgcaaccttagtgcttctacagtaagagtgattgccagtggtcttgcagtggcttctgagaagctacagagcaccagaatggaaaacctttcttcttctccttcccctctctttcctccccacaatctgtttctcagatgcactggctggcaaactttttctgccaagagccagatagatagtgaatatatttggctctgtgggccatacggcctcttgcaactactcaattctgctgttgttgcacaaaagcatccatagacaatatgtacacaaatgggcatggctgtgtgccaagaaaatctgatttctagacactgaaattggaatgttatatacttttcatatgtcatgaaatattattttcctttttatttttcctgaccatgaaaaaaatgtaaaagccattcatagctcatgggctgtacagaaacaggcaatggatttgacctacaggccatagtttgctgacccctgctttctggccattcttatgctcttgatctgtggatgactccactgcatcctaagggcatttcctctggttatagagaaatctacaatgagaaaccaaactgctatttacatgtattttttaaagctcctaaccattcaaaagtaacatcttaatttttatattaaaaatattttctttattgtctctatttcattcacttacaccttcacattatctgggcttattgatcctcatttatttggagaattttaaaataaccccatccatggagataatgctcttccttgaggggttgggtctgtcagtgtcccaattaattaattatacacacacacacacacacacacacacacacacgtacatatatatatatatatatatttttttttttttttttttttttgagacggagtctcactctgtcacccaggctggagtgcagtggtgcgatcttggctcgctacaacctccgcctcctgggttcaagcaattatcctgcctcagcctcctgagtagctgggattacaggcgtgcaccaccacgcccagctaagatttgtatttttagtagagatggggtttcaccatgttggccaggctggtctcgaactcctgacctcaggtgatccgcccacctcggccacccaaagtgctgggattgcaggcctgagccaccgtgcctggcctaattagttatatttaaaaccttccttctgctcatcgttagataaagatacctgattttacttcttcctttgaggttttgggtcaagaattatctctcatgaaaggaataagtctttaacgattttattagctattttgttttttaaaataaggctaggatcaagaaggtattgtccagaattataaaaatattatttacaataaagcttatttttgcattatataaaagaacacatgctcactaaagaacattaggtcaacatataaaaattgactgatggggaaaattccccctgaggttctgccacccaggcatattggaatattgcacactaatctttatgctgcccatatatatttttttacataactttttttttttttttgctttatacagaaatcaaaacacacctttttgctaagaaacttattttcttaaaaacaggactgagatgggccaggcgcagtggctcacacctgtaatcccagcactttgggaggtcgaggcgggcggatcatgaggttaggagatcgagaccatcctggctaacacggtgaaaccccatctccactaaaaaatacaaaaaaattagccgggcgtggtggcgggtgcctgtagtcccagctactcgggaggctgaggcaggagaatggcgtgaacccgggaggcagagcttgcagtgagccaagatcaccccactgcactccagcctgggtgacagagtgagactcttgtctcgaaaaaaaaaaaaaaaataggactgagatgtttcatcggcagttttcttgaatctctaatgtaacacaatgcaatgcaaagaggctgtttggaggatggcagcagagaaaaagaacaaaggaaaagcaggctccatttagagagtgggttaataaataataaaaactcgccacactgggtagtaatctacaggtcttccatctctagcagaaatataggtactgccgagctttctgccacagagggccttggtccccattcacctcccaccatccctctccccatggccacatctccaaatgattcattgtttctgctcacagagcacagcaagaatgaattccccagaatttcctcagctactacaaatacttttgaaatcttaaactaacatctgctaatgcccaggtgctacctggggttgacaaattgggcacccttctgtacttctgcagacacctatttagataatgttgccaggcagatggagatattaagccattggtgaaaagctatttcaattttagacttttttttttttggagtgggggaagggaggaaatagctggaagcttggtccacaaagttgcaaatgtctggtagctaagctgggcctggtgggcggagagtttgtggggttcagggcaggcggacaatgactgttgctatcaataggtgattgagatatgttcagtatattctttacccctaccccttttttggtccgtatctgtatggatggtttagataagatccagaactctaaaagccaaacatgctagctttctatttccactctgattggctccaaatgacatagtttaaaagtttcaattttcccatcttgaacatgggcatggagttataaaccaatagagtgaaagtatgagacttaaaccactgataattggaggctgaagcgactttagagagtgtctcgcccagtggtgctcatatttgagcatgtatcggaatcacctggggggcttgttaaaccgcagatggctgggccccacccccagggtttctgagtcaagatcttggagtggctttctaacaagcttccaggtgcagcagcagcagctgctgctgctctagagaccacactcttaggagctctggtctagttatactcacttatcttacgtacgagagaactgagtttcaaagcaaccaagagtcttaccaaggttatttagctagcagctagagtctggtttcgtgacattgaaccaactgggttttggaataccgtgtcaacactgagaaggatgaactgatatcaaatatcttgcgtatgtttccgagggtggtttaccggatggtggtctgctacaactcagccatttattgtggtctgttttttcagtgagtcaaggtctcttaagtctccaagctaaacaggagtactgcctgaagccagaatgcatcgaagcgggtaagtcacagttttccatcctgtgtcaagttataattatggtaccttgggaagtggaagagaagacaggtggtatttttagtattctgtttgcttgaggtttaccaagtacgaaatgcaattttgaagaaattttaagtttattttcaagttttggtgtgaaacagtggagcttaggtttcctgttttctttttccttgcaaaaactgtggtattctaagcgttgttacaaggaaatcaggaaggggcttggaaggctgaatggcctctcttaagacccacaggcagagaacattggtcttcctatggctccgctggctatgaattcctctttaccttaagcagttgcctatcttctggtctgtgggtctgacttgcctgcctctaagcaaggctcctttgcaaataaatccacgcttccattgtcagtgggagtcccttttctcttttttaaaaattgagacggagtcttgctctgtcgcccaggctggcacgatctcagctcactgcatcctccacctcctgggctcaagtgattctcctgcctcagcctccctagtagctgggattacaagtgcccaccaccacgcccggctgatttttgtatttctagtagagacggagtttcaccttgttggccacactgatctcgaactcctgacctcaagtgatccacccgccttggcctcccaaagtgctgggattacaggcaagagccactgtgcccggctgggaatctcttttttctgtcacacgttgcaagtcaaacttctcttgaggtgaccaggctgtgtatcagtggatatcccagggtgaagatgagtgtttaaagtggccgcagttttgccacagtgtcttatcccatcaaactcatggctggagttgccccaaaagcagcaacagggaaattcccatgagggaatatcccatcccgagatggggccagttgggattccaaagaaagaagcactaaataaatgccagggcggccggtcagtccaaagcatttattagtgcaacttatgttgaaagtgctgcagtgtatcctcaagacagtgagagaaaaggggtgttctacttagggcattagggtgtggagactatatgcgggtttaaggaatttggctcagagccggtactagtttctttcagtgttttgtgcatcaacctagatacctttatcagtgcctgggaatgttcaagggtccagtctggacctaagcctgctgggaaaaaccagcagctggaattagccgggcatggtggctcatgcctgtaatctcagttactcgggaggctgaggcatgagaattgcttgagcccaggaggcggaggctgcagtgagctgagattgcaccattgcactccagcctcggtgacagagggaacttctgtctcaaaaaaaacaaaacaaaacaaacctgcaggtggctgggtcacagagtggtcaggggattgtgtaatttttggttaggacaccgaaagcggcggtggggaggtgaggggaaacctgggggtcccacacacagctattagatttccctcctaaatcagtgttagggcctagatttcagggagccagattctagccctcaccctcattctttaagtgggcagggacacttttttcctttttccaaaaggaaagtcatcaaacaagcatgtggccctttcactttcctcttggccttaaaaggttaatgaacaaattcaccaaatatttgttgcacatgaggtactgagttaggttttggaaatagagcagtgaaccaggtatgggaagaaagacaataaggcaattaatacaatgagaaaattatgaaactgggtgtggtgacacgtgcctttagttccagccacatgggaggctgaggcttgagccctggagttggaggccagcctgggcaaattagtgagaccccatctctgaaagaaagaaagaggaatatcagtcagtggaaaatgttatagagaaaattaaaaaaaagatagaacaatgtgatagcaagtgacaggatggctagattgaaaagccggaggacatgaccttggaggtgacctttgaatgatgaggagggaactgctgtgtgaagactgaggcaagggctttccaggtggggggaacagatggggcaaagggtgcatagaagcatgaacttggtggacttgaggaacgggaggagcttgctaggtgaggtgcaagtgatgaggagtcaatgggggacccaagtgccagtgagtttgggctttccttaagtgtgctcgaaagcctctggaggcttttatgaaagagaatacatcttaggagcatttcaaaagatgtctcggtggagggctcagttagagggagtctttcttgatggagaagagaccatagggagcaagaatagaagaaggtgactcaagtaggtttatttctgtacgccaggtgacagacgatgctgtcttgaattcaagagatggagagggagaatgggggaaggtttaggaggtagagggcctattgaaggattcgatgcaggctgtgaacaaaagcagacaattgtgggtgacgcttagatttttggtgatggttgggcagtggtgtttattgagatgggaaacacttaggtgaaagagcttgtaaattcggagaccttatacaaaggtagtggcttagataattatgttagtagagttctttttttgttccattcttaagtgatctctctctctctctctctctctctatatatatatatatatatatatatatatatatatattttaaccaggctgtgtgttgagtgccttacaggcaccatctcataaaaccttcataagacccctatgaagtcagtgctatcaccagcctcactgacagatgaggaaatggaggcttctggaggctaaataactgcccagggtctcatcctgagttagtagcagagctggacttcgtgtccatgtctggctcctttccgtcttttccttggtgatatggggccatgccaggcaactctttttggccctggaactatctgagaactcccaggccctttcctgctccaggcttgagtagttgacctgaggttttctccagtggtgagagattgtcatggagtggggtgagagagcaggcggaactatcaggacaggttttagagtttatgtcacctggtgctttggctgtggtggggttcttgcagatgtgtgaaatgggaatttttgagctcataaattttcaacttgagtttagaacacttttttgtatggaaggccacttatttcatgagttttagttctgtattatgaatcataataatgcaagactaaaacttacagactgacattcaaagatgttgccttctgccagctagtgtgttctgccttgctgtcctgtttttaattttcacattggcgaatggctttctaatgttgaaaaaaaatattgattttgctgtttctggagtgaaaggctcaccaaagacccagttctctttagtgtaacgtgagcctcagtgtgcccaggggtctgcagaacagctgtgagtacacatggcaggagaattacggccaagccagggccttaaacaagaggctgtgcgtgcgtgggcgtgcatgctgaaagttcagaagactagagtgtttgatcgccttctggaccatttctgagcaggtgccaaccacttctgagatgcttcctctccataactctcctcttctctgtgtcctcttattttaatccctctttcaaaataagagctgtgcaaagaatgcaaagaaacaaggaaagggcatgcatgctcatgatcacagataagggcagacaggctgactgggtttgaagcatgatttagctatttacaagccacatgatcctgggctaaatatatagccacgctaagcctcagtctcaccaagtgtgaaatgggaataacaggttttacttatactagtcgtgagaataaaagaaaataataatggactgggcacggtggctctcgcctgccaccccagcactttgggacgctgaggcggacagatcacttcaggccaggagttcaagaccagtctggccaacatggtgaaactccatgtctactaaaaatacaaaaattagccaggcgtggtggcgcaagtctgtaatcccagctacctgggaggccgaggcaggacaatcacttgaacctgggaggtggaggttgcagtgagccgagattgcaggttgaatctgcacttcaaccccaagggggaggttgcagttcagcctgggcaacatagtgagactccgcctcaaaaaaaaaaaattagaaaaagaaaataataatggtagtagcagtaatttaggttcacaatgctgattcttaaccccaaacccagaaaacgatgtaactctcagttggcaagatgggggcctgatctcaattcctttgatggcaaaattggatcttaactcatgtgaggctgcttcagatttcatttatcctacttacaagaatatgcatatgtttccctatagaaacattaatgcacttgcttcaggcctgccactccagccattgctgaagtattacatgatctgtggttatatgcaatgtatttattttctaaaatctgaaaaatctatgagctctgaaacatatctaacctcaagagtttcagataagtgattgtggaattacagttcccagatttagctaactacatacatacgtacatacaggatgcttagtgaaatttgattgcagatacacaatgactactttttctggtgtatgtctcatggactatttggtacctacttattctaaaaggtggttgtttatcagaaattcagacttcactgggcatcatgcatttatatggtaatgtgcccaacactattctaagcactttacatatatttaatttgcataatgattccatggggtgctattattatccccattttcaggtgaggaaactaagacacaggttaaatcacctgcctaaggtgtcttagctgctgcatggtgtttctctcattcaaacacaagtggtctgactagagtttgtgacgataccatattgctaaaaaagggcttagcgtaggtcctggcaaaaaggaaatactcaatattggtgattttattattgttaattattattattactactctctcccttcatccttgattaaatctaaaaacagaggctggtatttagggaggatgcctccacctctaccacacaaacagcaactggtgactgtgtgacaattaaccttatatatagtgacttggaagagtacacagcctgagctttcacagatttccttcatcatcatatttcttttattaaaacaagactctgggttttctccatggagctgagtagggggaaaggcgttttggtgtcttgacaactatggtcccttgcaatttgaagtcacagttcccctgcagaaagtgcagccctgtgccccgctgtgaattgtgaatgatgaattgggaggctgcaactagagttttctcactcagcaggcttctttccaaattcaatgtgagtgatgtatttcccaacttttgtatcagggccaaggtcagagctgaccttgcagtttttctaggtacctgcaagaatactggcgagatggagaggatacatttgagggttgggggcagggaaagtttgagaaggaggctggaaaacagtgtactcatgtgggtaaaaatgcgtgtgagggctcccctgtgtgactgtaaatgttgtgtgggactgagacgtgtgatccatgtctctgaggtgtcacatagcagattcattctgtggctgcatacagtaactataaataccaaccaaaagaaagattttgttatgtcctagcacatttgcacattaaatattaatgataaaatagtagcagtaagtggccgggcacggtggctcacgcctgtaatcccagcactttgggaggccaaggtgggtggatcatgagatcaggagatcgagaccatcctggctaatgtggtgaaacctgtctctactaaaaatacaaaaaaaaattagccgggcgtggtggcgggtgcctgtagtcccagctacttgggaggcagaggcagcagaatggtgtgaacctgggaggcagaatttgcagtgagctgagatcacgccactgcactccagcctgggcgacagagcaagactctgtctcaaaaaataaataaataaataaataaataataaaaaataaaaaagtagcagtaattaaaaatgtaattagagacaactgatgctagttctgaagcacgaaaatgttaagccaatttgaaatttatcaaacttctaagtctttatttttatttatttttttatttttttaagagacggggttttgccatgttgcccaggctggtctcgaactcctaggctcaagtgatctgcccacctcagactcccaaaatgctgggattacaggcatgagccacagtgtttggcttctaaaccaattttttgctagtgttttttttttgtgtgtgtgtgtgtgttgttgggggaggtttgaaaatggtggggattttgaggccctatagaaattagaatgtttttatattattcacttcattgaagacaaaaggctgtttgaaatttttgtagaaagtctaggctggagaaatatctagccttatttttaaacctggaggaaccacacatgtaaccaaactgtaagatatgtatctaaattgacacagattgtacttttttggggcagttcattcatatttagctgaaatctctttgggttttcattacttcaaacaaaaatatattctggcattatttaaagtatgaaaattgcccagaatgtcatcttttcaatgtcattaaaatattgtctggttttttaaaaaaatcaattggtacataactttgtgctagaatggtagccagcaattgcatggcagctggaagagcattggagttcaatattgggaattctcattttgtaatgaagggttttcttttaaagttcatggttacatatttatgcacacatctcctacctgtgggttatcttctatatgtaattgtgtatgggcttatgaaagaggaaaaaaatggtagatcagtctattgtgtctttctgttaacttatacacatactcagttctactgctagacctgggtccctcatttagaacaccctactttggccctcctctggccatgcctctccttcagccaaggcgtctgtggagccaagtaggcagccctctccttctacaccccagaattccctgcctgatggccccaagctcccttccaggatctctgtgagtctcttctggggcttcatttctctgagagttacactgaatatcaaggagctcaagaatttgaaagtattttgtaaatataacttttaaatatttagatagatgacatatgaacttctgtttccattagccttcactgtgaggcaaaccacccaaaccatagaggcctggaacaaaaatgattggatatttctcatgattttgtggatttggtggatggtttctctgccgatttttgcctaggctcatttgtgccactgcattcagctagatgggcgcctggactggaaggcgaatgatggcctcagtcaatgcctggcagttgtgctggcttggttcttctctatgtgtcctcttgtcctccaggaggctgcttcaaagggcagctaaagggctccattcaaagggagttaatatggaaggtgcaaggcctcttaaggcttagctttgaaactcacagaaagttacttctgccaattctgttggtcaaagcaagtgacaaggtcagtccaaattccaggcaggggaaatagactctaccacttgatgggaagagcagcaaggtcactttgcagaaggacaagcaggatagaagaaatagtcacagttatctttgcaaacaattgaccacacgctctatttgtattcttgtcccataccccacagatgttagggatggccctgcaaaaaccagtgatgataataccaccaaacttttatccattccctttttttttttttttttttttgagagacaggttcactctgtcaccccaggctggactgcagtggtgcgatctcagctcactgcaacctctgcctcctaggtttaagtaattctcctgcctcagcctctgagtagctgggattacaggcatgcatcaccatatctggctaatttttgtatttttagtagagatgggttttcaccatgttggccagactggtctcaaactcctgacctgaggtggtccacctgcctcggcctcctaaagtgctgggattacaggcatgagcccttgcacccggcctatccattcactttgaatgtagtcatttcatatagtgaggtagattcagagagtttatttaaggggaaatataaatgccaaggcttggaaactggttgatatggaattgttgtttaatttggaaaagaacagtatacaacattcagtgcttgtcattaatcctatgattttctttctaaatagctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaagggtaagtttctactggggtttggtgatacactttatagagagcaatatttgacaggaaaaacatagtttgggatttgaagcatgacttctcactttttaactaccatgctaaattcatttccaagaatttttaaaatgaaagattgaaaggaaagtttgcagaattctggactcccagatctcaacataagactaatgtaggttgttatgttcatgtttggtaatagtaaattctactgccaaaggataaagagcatttgattgagattggaagcaaaggaatagttaatgaaaattatatcaatatactcatttgttgtattcagagtaaacttcatttcttgctcattgtgtcctggattttcatggcttacaaaatgtacttaacacctcatcatcttttgacatcacttttgagaactctggatgaccttgtggttgtcatattgttcttgttaacttctaagttggctctagggagattcacttttctcccatggccactctagcaatgacaagctcacacacacatactcacacgtggatgcatagaaacatacatatgttctcaaatacattcccctgccccccgccaaagttggaaatgtctgttattggaggatattctgttagcattggatctaatttttatgctaagctattggagaaggccacctcaggagggaagtaggaagatttcaaagccagataaggtaattattttgagaaggcaaaaatagtatggtttttttttttggctctttttgacaactgtgagttacaccatgtaacttgcattcagtaacacctacaaagaactcctgagaaattataaaaatcattttcccttcccatttacattttcccaagattttaaatacatgaaaattaaatatgtatcattttacaataagtaaaactcttggcaaaataaataattagatacctattgtcaattgtaaggaaaaatgtacttaaatttcacaactagatataaatcacatggacttatattttctattaggagacccaaatttagtcttggaaaattataaatgggaatttacaaggatgtcagggttttctcctaacccaaaaggaaaattctcatactataaaatcataaataagaccttgaggagtgagtttactaatacttttttccctgtagaacattaattcatgttggtctttgatttaccattcttgtccatttcctatttcccttctctggcttttcttaatagacagatgtgtacacacacatgtgcacacacacacacacgcgcgcacagtcatgcatacagaaacattactgaaagataagaaaactacaagatttccaggcatatgctccttttgcatttgttataacccaaagatttctatattcaggacatgaagtggttaacgataacttaaataactttccaggggtgtctggaattttaacataaaagttaaaatcagtgtcaatatgctttgtttgaggagggtactgtctacaggctccttcaaaatcaatagaaatgcaagtaaattgttaagcacagggtttttgtatttgctagcttccttttaaaaatcaaaaattttatttctcagctccattgaagaaataaaaaaagagcaaaaattagaagaaaggtcgctcataaatccgtcacaagaaataactgctaataaagcaactggggatatttctttccaggttttgttgcatgtgtgtgtccatatgcataacttcatatgcacacctatatattgtaaaaattagctgatattatacatactactctaacttaatttttaaaattagttggtattatacatactactctgtaacttaaaactatgcattcctcatagacatagattatgtcagtagataacttttcttttctttccttttctcttttcttttctttcctcttgtcacccaggctggagtgcaatggcacgatctcggctcactgcaacctccgcctcctgggttcaaacgagcgattctcctgcctcagcctcccgagtagctgggattacaggcacttgccaccacgcctggctaatttttgtattttttagtagagatggggtttcaccatgttggtcaggctagtctcgaactcctgacctcaagtgattggcctgcctcagcctcccaaagtgctggggttacaggcatgagccaccgcgcctggccaacttttcttattataaataacactgtaataaacatccttgtgtacacatctttatgtccttatctaaatgtatccttaggataaatttccagaaatggaattattgggttgaaagagtactctaaatttcatttttgatgcatatagccaaattgccttttagaaagtttatttcagctgggtacggtggctcatgcctgtaattccagcactttgggaggccgaggcaggtggattatctgaggtcacgagttcaagaccagcctaacatagcgaaaccccggctctactaaaaataaaaaaattagccaggcatggtggcacctgtaatcccagctactcagaaggctgaggcaggtgaatcacttgaaccaggagggagagattgcagtgagccaagatcatgccattgcactccagccggggcaacaagaatgaaactctgtctcaaaaaaaaaaaaagtttgtttctaggtctttatatttttttgatgttttaaaggataactttttcccatcaactgctttctgtggtataaagtagaagtcatcaaaccattgccagtaggcaaaatccagtccactgcctggaagttttattggaacacagccacatccattcgcttatgcattattaatggctgcttttgcactccaatggtacagtcgaatagttgcaatggaaactggatggcccaaaaagcctaaaatatttactctttgacctttatagacagtttgccaatccctgatgcctagtataaagtaaagctttgaatgtatgtattggattcaattagaactgtcttattagttgatagctccttggtagcttctttgaatttcttagatagttaataaagttaagaaataccagaacaggctgagcgtggtggctaacacctgtaatcccagcactttggaagaacaaggcgggtggatcaccttcaggtcagaatttgagaccagcctggccaacatggtgaaacctcgtctctaccaaaaatacaaaaaaaattagccacgcatggtggaaatcccagctcctcaggaggctgaggcaggagaactgcttgaacccaggaggcggaggttgcagtgagctgagattgcaccactgcactccagtctgggcgacagagtgagacttcatctcaggaaaaaaaaaaaaaaaaaaaacagaacggtgttgaaataatagcaatgataatgggtgtaattttcttatgccttgcttgggtggtaatgcctccagtatttcccctgaaaacgtacactttttttgtttgtttgttttagatagttattcttttttgtgttctgttgttcctagtttgcaaaaagctgctgctcaagaaaaatgcctctttgccatttatcaagagactcagatggagtatctcttttaacttatcttgatttacccatgctgaactaaacttataattttgaaataaatcctgcctattaatggtttgtattttttaagacattaccagaattgaagaagctagcattttgtttcacacatttgtctctatatttatgattcatattggtttgtgattgttttgtgtgctaggtttgtcgaattctgttattaagattgtgctggccttgtcaaacaaagtgggaggcttcctatatgtgtttctatgctctgggaaagacataattcaataaatcccaagttactctatgacaagcactgtaaaggccaaattcacaaactgacattagggttcttgcttcatatgtcaagaaggagagcaaatggtggaaaaggatctcttaaaattagtattttttaacaaaaataggtaaaatataaaatagctggacgcagtggctcttgcctgtaatcccaccactttgggaggctgaggcaggtggattgcttgaggtcaggagttcaagaccagcctggccaatgtggcgaaaccctgtttttcctaaaaatacaaaaatcagctgggtgtggtggcaggtgcctgtaatcccagctacttaggaggctgaggcaggagaatcgcttgaacccaagaggcggaggttgcattgagccaagatggtgccagtgcactccagtctgagtgacagagtaaaattctatctcaaaaaaaacaaaaaacaaccgcataaaatatctattagatttaaaaactttttattttgagataattcaaactttgataagttgaacaaatagcacaaggaacttctatgtaccctttacccagattccctgattattaccatttactacatttgttctattatatatatactttcattttccatctgtaaatatatatatagtgtatcatcctctacatatatacttatatacttttatacacatgggcagatagtatatgataaaataatatatctataaatgtagagataaatatcgatataaatacagatacatagatttttttctgaactctgcaagtatgttacagatgattagatattcttaaagtgtatagaggttttcaaatgtcaaatgtgctaaaaatcttatttcttttcctgaaacactgaatctttaaattctatctatatcttttaatatattctatatctatctatttatgtgtctgtcagtctagctacctagtcatccaactatctattcatttatcattctatccaggtaatacaggctcatcgtagaccaaccacaaataaacagcaaaagaagcatacttcaccacccagcaataacaactttttaaatgcaaatataggtataaaattatacatatcttctaagggatcatataatacattctatttaattaatttatttacttatttatttatgacagagccttgccctgttgcccaggctggaagtgcagtagcacgatttcagctcactgcaacctctgccttttgggttcaagtgtttctcatgcctcagcctcccaagtagctgggattacacgcatgcgccaccatggccagatcatttttatatttttaatagagacagggtttcgccatgtttgccaggctagtctcaaattcctggtcacaggtgatccgcctgcctcagcctccccaagtgctgggattacaggtgtgagctaccgtactcagccggatatactataatttacttaatcaatgcctgtgttatttaggttattttttatgttttcttcattgtaagccacttggaacatgagtttagaaacatcaagagctggatttgaatcctgattccctttcatttaccctctatatcactttgggccaattactgatctcacctagttcagttttcttatctttaaaatggagataagaatatacatatcagagtatgcaaaggcatacagagtggtgtaatagaccttggactcaaaggggggagggtgggagaagggtgaggaataaaagaactacaggttgtgtacaaaatacactacttggtgacaggtacactaaaatctcagacctcaccattatccagttaacctacataaccaaaaactacttgtaccctaaaagctattgaaataaaaaatatatatattttgaaaaaaggggaaaaaaaggaatacccatatcatagggattttgtgaagattaaaggagatgatttatataaattacccagtccagttcctggcacatagcaggccttccgtaaatatttgtcctttgttcctcgctttgtttcaaagatagttctaagattcatgaagtaatgtctatcaaatgctttaagttttattctggtattatcctttgtgtaaatatcatgtgctttcaaaaatattgaatactgtcaagatatttttgctcactcttgataaaaagagagaacatcccaaaataaaacccaatactaccaatcgaaagaataccattttcttaaggctgatagaaaacacacagatacggctgtccaatttgtgaaataaaatggacttgacagacctggctgatgaaaaattgccctctactgaagtgagcaacctggctttgtgaatttttttctttaaatggcatataagactcagattccgacttgggaaataaaattacttcctattctctccaagaagtgagattttttaaaaagccgaatataatcatatgtttgtcttaagatccacattctataaaccccccaaatttgtcttcatgtgaccatgaagaagacacagcatgcattgcttatgaatgagcagatggaaatttagcaaatgagcacttatgaaacatgaggcaatgaatgagatagaacacttatgtcacacagaagacagatgactcaaggtacggccagatcatctctattacggaatagctatctttgccaatattttgtgaagaaatgcaatatattattttcaagcccagcttcagcagaacaataagatgaagtagggactctgcattaatgaacagaaagagatgattgtgattcatagaccatttatttgtaaataccttctggctgagattcaaatagttctcgtaattaaacaccaccccctccccaaataatctttttttctgtaaatgatcctagccaaatcatcttttgcagacaatggaaatctgaaaacttcagttcctataaagtcatttagtgattaggaagttcagattattgaaaacagtgaattgtcattttcctcatgttgtatgtatagtagagctttgacttcataaagttcttaattttttaaaattattttattattattttttgagatggagtttcactcttgttgcccaggctggagtacagtggcaccatctcacctcactgcaacctccacttcccaggttcaggtgattctcctgccttggcctccctagtagctgggattacaggcgcctgccaccatgcccagctaatttttgtatttttagtagagacagagtttcctcatgtcggccaggctggtcttgaactcttgacctcaggtgatccgcccacctcagcctcccaaagtgctgggattacaggtgtgagccaccgcacccggccacttcatgaagttctttgaaacaagtaatatcagactagcaaatgtggggatgcagtggggaagtgctaaggaccaagcatccattgtggtgggctttttattactagtgaaaactcagcttctgtaattttgtgtgagtctcctatgtaaactgggtgcaccccttcagagaagattcccatttttctcagatcatgctggctctttttcacgtggccacatagaaagcaacaaattgccaagttacaaatatatcaccacagtcctatatgtgcaaaggggtgctgcatgaagatttgggcctgtattgaagacttttggaatgtgagattaaataattttacttgaaaagtttgttgttattcatagttttcctgctctgatataccgtttgagtattggtaggtgtgcgtgctgcatggagtgtggggagaaggtaagaagttgtcagattagggctgggcgtggtgactcacacctgtagtcccagcactttgggaagccgaggcggttgggtcacttgagatcaggagttcaagaccagcctggccaacatggtgaaaccccatctctactaaaaacagaaaaaattagctgtgcatggtggcgggcgcctgtaatcccagctacctcagaggctgaggcaggagaattgcatgaacctgggaggcagaggttgcagtgagccaagatagcaccactgcactccagtccgggcaacagagagagactccagctcaaaaaaaaaaaaaaaaaaaaaaaaaaaaaaaaaaaaaaaaacagacctagtgctagatatgaaatattcccaacacacaaaataatgataaatgtttgaagcaatggatatcccaattacccagatttgatcattacacattgtattcttgtatcagataatcacatgtaccacataaatatgtaaactataatgtatccataatcattgaaaattggaaaactggacaaatatagaaatttttttttctgaaggctctgtggaagatgtgaatgtatctctaggatatgttctctttctaaatagctaaatgaactaaagaggccatcagagtgactactgtgtgtaaaagcttgtgttttggtagttctgacagtcagcctgtcaggttttctttttttttttgaggcggagtctcgctctgtcacccaggctagagtgcactggcacgatctcggctcaccgcaacctctgcctcccgggttcaagcaattctcctgcctcagcttcctgagtagctgggattataggcatgtgccacatgcccagctaatttttgtatttttagtagagacggtgttttgccgtgttggccaggctggtcttaaactccgatctcagttgatccacctgcctctgcctcccaaagtgctgggattacaggtgtgagccaccgctcccagacaggttttcttcttatgtgtgcttttccaccctcagtgcatgtccttgtcttactttttgactcttgtctgctctaagccttccattttaagatctgatctcttcccctattgctttaatgtagctcctctgtcattagcggtttctactacaaataagttgggtatgcttggtaagaaccagctctgttcattccattcattctaagttgtatgatattcagctggcgggaagttcaccacttcaaatagattgaaatgcacaacattttgattgtactactctgtgaaaatagtcttatttaccaagcatttacttttattcctggcactaattgctttcaatcgtaagtaacagacagcccaactcaaactggcttaaacaataaaatatgctgattcatgtaaccaaaaagcctagtaattatgtagacttcaggtaagggctgatccagcaactgaaccatgtcattaaggatcacattttttttttctttctctctctactctgacatccaccatgtcgtatttccttctaagtctgtttggtcatgagattgttgctaataaccagaatttatacttcctcattcatatctagcaagaggcattgtgttagacacaagggatacagaagtacaaagattaataaggtcccctaggctgggcggggtggctcatgcctgtaatgctagcactttgggagcctgaggtgggtggatcacctgaggtcaggagctcaagaccagcctggacaatatggtgaaaccctgtctctactaaaaatacaaaagttagtctggcgtggtggcgggagcctgtaatcccagctactgggaggttgcagtgagccgaaatcgctccactgcactccagcctgcgtgacagagcgagactctgtctcaaaataataataataataataataataataataataataataatgtcccctagactatcctcatggaaattacaatctgcatcttatgagtgttcccataggtattgtaatcaatactctagaactgtcctgctcagcatggtagccgctagccactgtggcttttgggtacctgaaaatatggctaggtggaattgaggtgtgatgtaagtgtaaaatatacaccaaattttaaatacttcattttaaaaaatgaaagcactctcattaattgatagtttcatttataatcagtaattgcatgtagaaataatattttgagttatattaaggcaaataggatataccattaaacatctcacctgtttctttttacttatttaaatttagctacaagaaaattaaaaattacgtatgtggtttgggtaatatttctaccagacagcattgctctagagccctgaacaggctattagcaaggtgaaatatctgggaataactcaaatggatttcagtgctagagaaagctcagagaacacctttatttaaaatagtcctctggctgggtgccgtggctcacggctgtaatcctagcactttgagaggtcaaggtgggcagatcacttgaagccaggagtttgagaccagcctggccaacagaataaaaaacaacaacaaaaattagccagacctggtggcatgtatctgtagtcccagctactcaggagctgaggtgggaggatcacttgagctggggaggccaaggttgcagtgagccaagactgcacaactgcacttcatccagggcaacagagcgagactcgatctcaaagaaaaaaaaaagaaagtcccctacccaatctccaatccctttgtatttgtgtcctttgtggtccttataaccatctgaaatgatgtcatttgtgtacatgcttgctgttcttctcacttacacccatccccgctcctgtagatgttaaactccatgagaaccagccccttgtccattttgggtgtcactgtgaccgcagcaccaagcatagtgcctgccataggaggtgctcagtaaatacttcctaaagaaaggaagaaaagaatgtgccctctgtggttggctgagtgcagttgtgggggcagctgactgggtagggaggagtggctttttcttctccgtttcactccatctcctcctgtgcccacagtcccagaagactcttgagatgcaactggggcttgcccctgaaaggaggggaagcaaaatcatcagtcattttccatttgtgttctgggcctcaggaaggcaggacagggacgtgggcaatgagacaggcctgggcccttctaagactccctgttggtgggatctgatgcaagttacagacaagaaaaataacttgcaggtggttcaagtttgggttctgagaaaagaaaaaaaaaaagggattctgccacttatcagctgtgtggccatgggcaaactacttctttctgagcctccgtttcttatctggtgatactgttggacaaatccaatgagatgcgtagaaagtcttctacacatggttcaataaatggaatccgttgctactgttaatttcacaaggattaatgttttaaaagcacttggcacatagtagatgcttaagaaatgttctgcagccaaataaaaataacttagaagaagaccttgacatcactattaaaataaaatattgtgatctagttttttttctcaaactccccacatgcctgtaaataaggaagctggttctgaaagaggcaaggctggagataaaaaacagcagatgaggacatttgtacgtattcccaacttgcattgccagaccttggtcatgaccctaaaccctggacggttttgataatctaattgtcagataacacattcattggaggccatgtgatttttaaatcactcccacaggaagagaaagaagaggaaaagggaattggtaaaaataagaataactatcctcttacgccgctctagagcttctctggatgccacttaaaaaaattctaccaatttcccttcttttttcggacatggagtctcactctgtcgccgaggctggagtgcagcagcacgatctcggctcactgcaacctctgcctccccgattcaaatgattctcctgcctcagcctcccgagtagctgggattacaggcgcctgccaccacgcctggctaatttttatatttttagtagagacagggtttcaacatgttggccaggctggtcttgaacacctgacctcaggttttccacctgcctcggcttcccaaagtgttgggattacaggtgtgagccagcgtgcacagccctcatttccctttgttctctcttctttcttatccctaggggatccttaacttgagtccacagtcttcccacaagagggctgtcaatacaattcaggtacttggatgggaaaaaattgcacctttgttttcactaacctctcacagaattttagcattttctttaattatgaatgtaggcaacaaaccctggtactattagcagtgcctgtgactttgttaccaacagcaatcatgattatttttctaccttattgcagatgttgcaggtatcttgaaatgttatgtacacgtatcactacttcaaaattatagtagttgtcagactcaaagttagggcttggtatttaatgaattaatcaaatagcacatatatatatttcacacagtaaaaaaagttgtgctgtgttttgaaatacctgtttttctttgtaagcctatgtttcttattttatgtacttataaacattattctcagaatggtccataggtttcaacagactgctcaagagatgtaggcagaaaaaaccattaagaaccccagtgtatgtaaggattgctagagcaagattcaagaaggcagttttatttagctccagcctcttgatccatcttaattcaggtgcttggagtggcattgactattacgtggcctcatgggtccactcatgcccaaatctttgagtacttcactgtctagactcccggggtaatgagcatgttactgacagttaatatgtgtttatgaggatattagatgaaactggagtttgtaccagtaccaacccttgaactgattaaatgcagtctttatgattgtctatgccttggaacctgtatattttcaggtgaaattactaaggcttgccatgtgcttatcatgaaagcagggcattaaaggtcaattctgggcctggcagtgtacatctgtagtcccagctactcaggaagttggagagggaagaatgcttgagcccaggaattcaaggctgtagtaagctaagattgtgccactgcactccagcctgggtgagagagcaaagccctgtctcaaaaaaaaaaaaaaaaaagtcaattcttattcgaagtgatatagcttttatgaacagtgcaaatgattggaaatagtaatacaccaagtagagtgtttatccataagcagatactacatggtgtacaacagagctagcttgttattcaatgttgaagacaggggctgttgattgaacttagaagggtggggagtaagggagtaggggaactgcaaacctggaggtgctgggagctaagtcctaagggtcagatccaatatatatagcttggctttgttggaaggaaggaatgaacagggcctttggtgagagatgacaggagataagagatgttgaaatccattggtgagatttttgacttgcagcagggaatgctaaggtttctgagaagtggagcaatagcctgcaaaatgctatgcatgggaatattggctgaaaaaaatgaatgggaaagcagacaagggggcatttttgtagcataaatattgccacacattatgaaaagtttcctgtgagttagcttgaatgttgtaggaggaaagaaacatttcactttagaagattgtgggctaaatttaggttcctttgactaaatataagttcctcagcatgactaataacacaggatatgtgcatcctgagaaagacgtatacacccacaatgacacttttccacctgcccacacccaggtcctgttttacaaggttggtatgtttaagtgtattttactttgcagttgttcagaaggattgcatatttttgaaaaactacttcctgaaagaggatgactgtttggaaaggaaagaaaaatcctagctggctttggtggtaacagttgggaggcatacccacgtgagctttggtggtaacaattcctgaagcttctccaagggtccacgtgttcctgctgttggttgccagaagccagaataataatggagctgagaatatgggatttttgtgagaaattccaggggcattcagatttcacagcagaagcagatgactcagatgtcctgcgccttagagagatgcgtgaatcccttacctttaccatactctgaattggtcaacggcagaatggaagccctacaaaaattgaaaagttggttgcatgctaacattcatagtggaactgagttgaaaattttatccttgtatttccagactctctgattagattgttttagctatgctctcacccccaattctgagaacttttcaactgtgactgaggtgtggatgggtcaagcatctttacaatgtgacaaaatccccatttctcctctgatttactactaatggggagataattcattactgtgaagtgagcctttaatagattaaaaaagttgtaagaatatgtcacatagggcaggacctaacagggctgggcactttattgaggtgaccttatttaataatatcattagttatcatttattggactctgaactgagctcccaacacggaagatgtaagatttatctgcattttacagatgagaagacagaggcaccaagcagtataactagcccaaggtcacacggctgatatgcaatggagccaggattagatttgggccatttgacctttactgcctggtaaaagccctgaaaactaggaaggtgatattattcctgttttacgattgggcaaactgtggcttagagaggtgtattagtctgttttcacactgctataaagaaatacctgtgactgggtaacttgtaaaggaaagaggtttaattgactcacagttctgcatggctagggaggcctcaggaaactgaaaatcatggcggaaggggaaggaggcatgtcttacatggcagcaggtgagagagagtgagcaagagcagggcaaactgccttataaaaccatcaaatctcttgagaactcattcactatcacgagaacagcatgggggaagaatgcccccatgatctaatcacctcccatgacgttcttccctcaacacgtggggattatggggattacaatttgagaattctgccactgaaccacccatgcggggattagaatttgagatgagatttgggtggagacagagccaaaccataacaacaggttaagtaatttacccatattcacacaattagagacctataaagataccttccagagtagtattgtccgatagaaatataatgtgagtcacaaatgcaagtcacatgtgattttatgttttctaggagccacactttaaaaagtaaacgtgtcagcagttgggatgatatattttatctaccccaatatatccaaaatactgttatttctacatgtaatcaatgtagaaaacttacccatgaggcattttctcttttttctttcttactaagtctttcaaatgtggtgcatatcttaaacttgcaacccttctccatttggaccagccacattgcaatacccagtagcctcgtgggactactgaaaagtacaattctagagtggtggttctcaacccttgctgtgcagtggaattactagggagcttataaaacacagatgcctgaggcccattctcagagattctcatggaattgatctggggtgctgcttgggtgttaggatttttgtttgtttgtttgcttgttttttgagacagagtcttgctctgttgcccaggctgtagtgcagtggtgtgatctcggctcactgcaacctctgcctcccaggttcaagcgattctcgtccctcaacctcccgagtagctgggattacaggtgtgtgccaccatgcctggctaatttttgtatttttagtaaagacggggtttcaccatgttggacaggctggtctcgaacccctgacctcaagtgatccgcctaccttggcctcctaaagtgctgggattacaggcgtgagccactgcacctggctagatgtgaggatttttaacgacctccctcccgaccaggcagtgcccaaactaactgagtagaaaactgtagcctttgtacattagagaagtttctgtgagttttctgagatgagaaccattcagaatgactgctctggcagtatgctttgctagttgacattaatgaatgccaagcaatgcccaactaatttattaatttctctccatttacatttcccaacatgttgaccaagtctccagaataatataagaaaagagattttctttctcttgctgatttacacattggtctggatacataccagtgaaagtaaattcagacataaaattctactcttttaattgaggtcaaaggtgttggtgtcagcctggaatctctgagctgtggagaagaggaagttggggtttgaaagctgcaggtggctgccagaatgagacaagtctagtggggaatgcgtgggaggtgctgggtgaagaaaggaggcaattgtgtttcgcctgaggtctgaaggctgcatagcccgctgtgtctcaggacgttcacaaagctgccctcaccagaagcgtcgcgtccaccttcccactggaccaaatttttgattctgcccctgaaccctggatatgaaacccaatactgaagaattaaaatgtctcatctcacccggaggttcagttgtccttaaaatgcttttggattcatttggaataatttctatattggcttctttcatttaaatccaaatatagcttcagtatttctgacatatttattactttccagaatggaaatactagttcttctgaagtggtagctatttagttatagtcaattttgttagttatgtttatttgacttcaaattaagccagagaatatgcaaacactgcagtgtcttccacagccttaccaaaatgaataccatatttcatcaaatcaaaaatattgtcaactgtaagatgcaccattgtttcacatgagctaagaaagagtaagctattacatgacgcttttttatcacttggaattttattttgtgttcattgaagttcttttagcctgacttagacataactgtttaaaaatattttaacttttattataggtttaggggtacctatgcaggtttgttacgtaggtaaacttgtgacttgggggtttggtgtacagattatttagtcactagacactaagcatagtacctgatgtttgttttttttctgaacctctcccctcttcccaccctccaccctcaagtaggccccagtatctgttgttcccctctttctgtccatgtgttctctcattatttagctcgcatttataagtgagagcatgcagtatttggttttctgttcctgcattagtttgttgagaataatggcctccagctccatctatgttcctgcaaaggatgatctcattcttttttatggctgcatagtattccgtggtatgtgtaccacgttttctttatgtagttccagaaagttctcaggcgatgcccatgctgctggtttggggaccacacattcaatagctaggctttagtgtgtctaaggacatagtatgtcactgaagaaattcagtacctctccagggtacatggatgttttaatttttcttccatttgtattattattttgatgaaaatgtatatattgcaaatttgtttgccttgcattgggtaaatgcaaaggaagaaagcaggaattttgtatgtctgatcttatggtacagggagagagatttttttccccttaatttgtttcatgaaagatttgttcatttccttttcctttgctttctttatccaacttgggaaacttgaatttattaggaaatctgcatgtaattgcagattaataacctacccattaataccacattagttcatcatgattaatagcatctatgtgaatacttaatgaatttgtaatgatggactatttgctttaaagcgtcaagagaacattccatgtaaaaaggcactacccgtaacaggaaaattaattatatgctggttggataatagcttgtcacaaagaagatatgtttgtttggaaagcctcattggtattgatatttgcagtgagaggtactttttttaaaacattcatgaaccttttaatttgtaaaatgagaaggaaattttattttcatgaacagttaaaataggtgtagggactgatatttatgaaagagagcagcacaaacacaaatatgtgctaatatactcataagtttacctatgtcactaggcagaaagacttcctatagtggccatttagattaagttccgaattgaactgcttctactacccactggtctatcctaaattcacaagttcacttctttaaggctcaagcattttttttttcttttgagacagagtcttgctctttcaccaggctggagtgctgtggcatgatctcggctcactgcaagctccgactccctggttcaagcgattctcctgcctcagcctcccaagtagctgggattacaggcatgtgccaccacgcccagataatttttgtatttttagtagagatggggtttcactatgttggccaggatggtcttgaactcctgacctcgtgatccgcctgcctcggcctcccaaattgctgggattacagacgtgagccaccgcgcccggccggcccaagcatttcttgatactcattttatttcttcagagaatcatttgttttctctactgtcttcactctaattctgtgatgtcagcagtcatcattgtttatttctgtctttgccctatatctgaggaagtgaaggtcaagaagattatgtgacttgcccaaaccaatccagccatataatttgttcgccacagattatgggtctctcatttcaaatgtctccagttttaaccccggcggaaagagttgcaagcgcagagactctgtccagctggtgcctttgaggaaacccaagaagcccagtgtgattggagctctgagttggaagggaagaggcataaatgataaaactgaggagaaaggcgggggccagagcatacaggctttgtaggccgtgtaaagattttagactctatcctagggcaatgggaaggcgtttgtaaatgtcatgttgagggatgtaatgagcgatatgttttgccagagcttgctgctgtctgtggagagtggcttggaggaggtagctgacaaatggcgaccaattcatgctttacaggccccatcatgttgatctattttctagtctggtatccaaacgaaggtggagtttgacttccttgttacagaaaataccaaggcatgattgtttatccttttctctattttctccttaggtcaacatgaaagatcattgcttcttctttgttgcccttgatttctttgaacttaggaaggtattttgtcaagcacccccactcatggggcaaaatctgccagggaagtcatggcagctactggtgggcatggtagttagtactcgttctaccagcacttttgcccctttgggttcactgcttgtgccaaaggtgctgttgcttccccccttttgggggagaggattctggatagagaaggaaagaaagccttacccctaatcactcactgtcggaaacccagttctggaggagcagtctccctcgaccacacattgtggtttgaacagccaggaatagaacccctccttctctcacctcctcatagaaggtgggagtgaaaacaggggttagttgggaagtggctttttaaacctatgtttacagtgttttgatgtcactttcatagacgagggaggaattgtctgaagctcagattttttaggatttcagggatgtgatgtttatctctctcttcctctcttgaggatgtggtataaactggaattgaaaatagatacccggctgggcgtggtggctcatgcatgtaatcccaacacgttgggaggttgaggtgggtggattgcttgagcccaggagttcaagaccagcctgggcagtatggcgaaacctcatctctactaaaaataaaaattaaccaggcactgaggcacatgcctgtggtcccagctactcagaaggctaaggcaggagaattgcttgagcccaagaggcggaagttgcagtgagccaagatcgcgccactgcactccagcccaggcaacagagtgaggccctgtctcgaaaaaaaaaaaaagaaagaaataccctgtatggtattctttctttcactttgagagtctttctggcatagtgctaatatttttttccactcttgaatctgtgaatcaaccctcacatcaaacccctattgcattttatgtttaagaagggaactttttaaagctgaggttggcagaactgagaaacttagacctaaatgggcctatgcaaggagggtgtttccaaaacaaaacaaagtgtttagtgtcctccttgaagaatgttgacactgagttaaaatggagctgcagagtgaggaaatcagtaaagacaggacaaaagttccttttttgatttgaggtagggtaggaaaggcagaggtgggattctgggctggtgatgtttccagggattgcaggcatcaagaaagaccggtgagtgctgttggtttaaagtagttgttctcaaagtgtattcccccgatctgcagcatcaacattacctggcagtttgttagtaatgcaaaatcctgggtcccaccccagacctactgaattagacactcaagttaaaacacagccatttgtgttttaacaagctcccattttttttttttttttaaatttttgagacggagtttcactcttgttgcctaggctggagtgcaatggcacggtcttggctcactgcaacctcaaccttccaggttcaagtgattctcctgactcagcctcccgagtagctaggattacaggcatccaccaccatgcccagctaattttttttttgtaattttagtagagatggggttttaccatgttggccaggctggtctcgaactcctgacctcaggtgatccgcctgcctctacctcccacagtgccgagattacaggcgtgagccaccgcgcctggcctaacaagctctctttattattccaatgttcactcaagtttagaaaccactggcttagactagagcaaaatgtgaggtcaagccttgaggaccagccaactttgttctgttctaacctcaccaggcctcctacctctggttaggtgccccaggagtctgtgtccctggtcaaaaatagggtgacagggcaaagggagtagatggctcatcacaaagacattgcaccactgcaaaaagaagttatgatgtaaccagggaaggtctttccttcagttatggtggagagatctgtcagggaattccatgagggcatagctgcctctcatttagccactgggggcccattctctcacaggaaagcaacttgcagaatttttctgggtatctgatgtttgaattaacaggagtcagagacctgagtccaaatcctagctctaacctttactaactgagtctccttggacaagttcttatagttttcttgcctgcacaatggagttatgatatatgtttcttaggattgctgggcaggttaattgaggttatgtattaatacaatacatctggcacagagcaggtgcttaaaaaatgaacactgtcgttactggtccttggatgtcttaggattgttcaggaacgaccattgcagggagtatataaacatacacggctttttccttgtaacgttaagatggataaaataggaggcagaggccaggtgtgctggctcacatctgtaaccccagcactttgggaggccgaggcaggcagatcacttgaggtcaggagtttgagaccagcctggccaatgtggtgaaaccccgactctactaaaaacatacaaaaaaattagctgggcgtggtagcacgtgcctgtaatcccagctattcatgagggtgaggcaaagaatcgcttgaacccgggaggcagaggttgcagtgagctgagatcatgccactgcactccagcctgggtgacagagtgagactgtctcaaataggagggagaaaaaatataaataattagagttagtagtaaaaatgctatacgaaaaaactgaggatagatttattttaaacctcaagtttggcacagaccttacatggaattatctgctaagatacaaaatatctaaataggaaagctatttatattgagttaaaacataagattggcagattcattgtaatgctatgctatcaaagaataatgctaaaattgaaattattttgaagtataaccttgataataagtataattcttataaattcacttataagtgaacataataaaagagttatcttctgttagagttttgtagtatctggcaattttatataattaatttcattatggacaaggaggtcttttgtgttaacagggacatttttgtgttatttggtaacccatgatttagaatgatttagaggattttaatccccttaaaatcatctctgcacctttttcttaagctgatgctaaccaacaattatcatttataagatcataaaaaatgaacagagaaaataattctgacagcttctatccctatatttaggtgggagttttctagaggaatgagaaagatcagctcctattggcttttcagtatgtcatacagattcagttaatcccatgcttgactggccgtgaggctgaggaactgccaagctgagtgtcacacaattcgtgtgaaaatatatgagagttacgggatccacggaccatgacttagttaacttgaattttattttttaatgagaataacaataagctttgcaagcttatttagagtctgcagctttaagtgcataagggtttaatacctttaatacccatgcagtgtgagttagaaaaatgaaaattttcagtatagtaaataaactgaggagcctggaaaccaaattgaaatctgtagcctagaaaatcaacaagagctaaaaatagtaggattagaggcagcattcaaccatagaccatccaaaggtagtttttaagtaccaccaaaggagaaagcaggccattctataataagttttaaaaaaaatctaggtctagagaacattctgttcattatgtagatgtggaagcttaaagtatagatttggttttccagagttttaatttttcatgttctttttttcaccagaatcagagggcactccctctgatttccaaaagagaaatgttaccacaatctgcatgaaattgagaatttaccttgctgacactgacgtgaagattttagaatgcagttgctggccaggtgtagtggctcatgcctgtaatcccagcactatgggaggctgagttaggaggatcacttgagactaggaattgaagaccagcctgggcaatatagcgagaccccatctctacaaaaataaaaataaaacaattagccacggtgtggtggtgtgcacctgtagtcctagctacttgggaggctgaggtgagaggatggcttgggcccaggaggttgaggattcagtgagctgtgattatgcctctgttctccagtctgggtgacagcacaagaccctgtctctaaaagtacccattaagcaaatcaagcaagtggctccaggattcactggtctcttagcaaagagccagaggccccctttcagaataggcacatggaaatattgcagggtcaggagaaagaacccaaaggagggtgtttttaagtgttcctgtgctcctgagccacttcattcaaatgtcagctcaatcaaggttcttggtaggtttttgctcataggcctaaaactttgcatgtgtggagtttttgaaaaatgttttaggtggatatgtcttagatattgtagaaactttaaatgattggcctgagctgcagatggctgttatgaactcttgactaagcatggtactgtaaaatcctcaagggcctcatccttcctttggaatttcctttttgtattctagagcactcaataaatgtcctgtctgagcagcagaattgaattgagtgaggattgatagtcctctctcagcttccgagcagaactaagtattttttttctccccagtgtagaagagcagggcattgggaatggatgataaagctgagacaattgatgaaaataaaacttaggtacccttaaaactggcgttcatgaaaacagatgaatgaagtcttggatttcattgtatgatatagggactgagatgtgaaaaaaagagatggtgttgttagtatgatcagggcattgctgattgtaaaaagaaataataaaagtagtcagtccagcttctcatagttctttttcaattggatgaaagtctctctcagactttccttgtcaggaattcaactcagcgaacattcactaagcaccagccatgccaagctctgggtcctgggtgttcaaagatgaatgtgacccagcccctgcccaaaagagtattcaatctaatggagcatagccattgttaatgccaatgttttataccaaaagtatttcttggtgatattatttgaggcccaatgaccaaaaatatctttattattaaaattctcacgtttcatcccctttgaggctaggcttgggttacaaaggcatggttgtccacaccatggtcaaaaacaaattttagatggactgtagatctaaatgtgaaacaataaagattttagaagaaaatgtaaactgtcaccgggcgcggtggctcatgcctgtaatcccagcactttgggaggccgaggcgggtggatcacctgaggtcaggagttcgagatcagcctgaccaacatggtgaaaccccgtctctactaaaaatacaggctgggcgcggtggctcatgcctgtaatcccagcactttgggaggctgaggcgggtggatcacctgaagtcaggagttcgagaccagcctggctaacatggtgaaaccccacctctactaataatacaaaaagttagctgggcatggtggcgcatgcctgtagtctcagctacttgtgaggatgagtcaggagaatcgcttgaacctgggaggcggaggttgcagtgagctgagatcctgccactgcactccagcctggcgacagagcgagactccatctcaaaacaaacaaacacacaaaaacaaaaaacaaaaaatagctgggcatggtgacatgtgtctgtaatcccagctacttgagaggctgaggtaggagaatcgcgtgaacctgggaggtggagattgccgtgagccgagatcaagccactgcactccagcctgggcggtagagcaagactccatctcaaaaaaaaagaaaaataaaataaaatgtagactatcttcatgagtttgggataggcagagatttcttgaacgggacactaaatatggtaaccatggaggagaaaaatggagaagctgaactaaaataatttcagtttattacaagataccattaaaaatgaagtctatgtaatgggatattttataatatattcaaaaaggactcgtacgtagaatatagaaagcacttctacaaatcaataacaaaaaggtagattgctctataaatatgtgatatagacttgaataagtattttaccatagaggatgttaattttcttgcttggggttagtgattggaagggagcacaaggggcttttggggttccagtaataatgctggttacttgagcgtgttaactttgtgaacattcttcacattatgatctgtgtacttttctgtatgttgtattatttgtgtacttttctgtactttcattggaaaaatttacataaaaaaagaaaatgctttgctgtccaggatgaagaatgtgagcagaatatttttggaggttaacactgattgcaaaatatgtcttcccatttagaattgcctctactatagaagcagaggaaatgttgagagcatggggctttgcaaggtggctatagcaggtgcagtttgtgaaatagtcctacacacagcctggcagtgtcttaggttagcataagtcctttggccaacaatatcctgagaagcaagcaggagaacaaacacagttatggaggaagcactagaaacaagcttgattacttgacagttttgtatagggcgaattctgcctgtaatcctgtttaagtcaccacttactgatccccgttatcatgtgcccaggcaccaagatgggggctttctgtgtattaaaaattttaaatcctcagcacaatcctgggaagcatgtactattattatttgactttacagataaagaaactggggcttagagggattaaataactcgctcgaattccagctagcaagttgcagcaagctgcaactggaacccatgtctgtgtgattccaaagcacccccttcccacatgtctattatgttgcctttaaaaaaaagttatttgatggagcatagtgagaagaaaaatacttaatatgtacttaatgttcaaatttgatgatcagaagaacttctcaaaccacttttaaagtctgaggtttgctgtgctatagtttttttttttttttttttttttttttggaaacacactttgtcgcccacgctggagtgtagtggcgagatcttggctcactgcaacctctgcctcctgggttcaagcgattctcctgcctcagcctcccgagtagctgggactacaggtgtgcgccaccatacccggctaatttttgtattattagtagaggtggggtttcaccacattggccaggctggtctcaaactcctgaccttgtgatctgcccgcctcggcctcccaaagtgctgggattgcaggcatgagccaccgcgcctggcctgcagttttatgaactgctattgtcctttgcagttgtaaggtggtaagaaatacctgggtggggtggaggtggggattgagaaatcctccaagaaacaacacaggctatgattggaatgcccctgtatgggtgacccatgagcctttctcaatgctttggggacattttaataacctgagtaattacctgtggtacgcaggctttgttttctactcattaataactctccaggctacattttattcttcttactgctaattcacatgcagagatacataaaatggatgctgtcaactgattgccacatcactgtctgcatatcaatgctctcctgtctgcttgggctcagagagaaggaaagaagagaaggaaaagggtatggcaaggaacttgtgatagccgaatctgttttaaaagccaaattctggtacagaaaccagaattttgacatatacaaattattgatatttgtgcatggttagtgttttgggattgccctatttagcatctgctgatcctctttttccctccctgtgatagatagcatgccttggaagcagacacaggtaaatatttaatgcttttagttttttttgctcctgtggcttgtttggcccttagggcattcatgttttttagcctgtggagtgcttatagcatcagaacatcatcacaaccctaaatgaaatttggattatttacttctaagtatgtttcccaaatagtctaatgactgtgtaagcaatatagtggaagggtacaggagccgatttgaatggaaatatatgtggatatggctttagatctttctgcgtattaaaaaaaaatctcctttaaaaaatccttggggacctggcacggtggcagtggctcatgcctgtaatcccagcactttgggaggccaaggcaggtggatcacctgaggtcaggcgtttgagaccagcctggccgacatggtgaaactccatctctactaaaaatacaaaaaattagccgagtgtggtggtgtgcacctgtaatctcagctactcgggaggctgagacaggagaattgcttgaacacgggaggcagaggctgcagtgagctgagatcctgccactgcactccagcttgggtgacagagtgatactctgtttcaaaaaaaaaaaaaaatccttggggctagttatcttgattttattattatgatgatacacaagaaagaaaacaccaaacaagctgaaataattgaaaatactcacatccaacccaatttaatttatttcactggaatctatctagttatatggacttgttttaggtacaggtacttatttttaaaaaactagacaggagctctgggttgctttttttttttttttttttttgaactgtagaacttctggtttagaagtaagattcctcttcaggagatatacaattatttattaacttaattagtgccgtacattttgtcttgaagctattcagagtattataggaacatctgttgtactgtgattatgatggctgctaggctgtttccccaaatgccttgacaaggcagtttgacatagttcggtgaaggcagtgccctggtgctgcagtcaccatagggatttttcatcttggcttcatgttggtagattgatactctcaagtacgttcaaggttctctttttcgggagagggttgttttcattgagtcctggctttcctctttccttatttaatgaaatagtgacaactatcattttctaccttcaaacattattattagtgattttataaatagaaaattattttccaggtgggcctatgtctgtgctggcaaccattgtgtacacacggactctcttagatgtttaggactttgcatgtgtaaacgggcaagttttcaggcaattcgggtaggttttccaatcttgtctttccatttcctgtctaaagaacttcttccatgtccacagcatgtttattcaacaatggataaaacttctaatgggaaatttcttccgggtgacctccttgagaggctgggctgtggagaaatcttaagaaacacaaccctgatgaaattggctccgttgagaatattacttggtccaggaacaagggacagaattcagttatttttggttcttgaataaatgaattctgtttccttttgtgtaggtggcagaagaaattaacccctgtagaacatccattctcagttggaaattaaatttttggtttcttttgagttaggagtaccctggataagagaatgtaaaactgtttttatttgaacctcatgcaacttggaatctgttctgttgtctgcatatctttgatagatttgtcttttccagggttgtctgtctttgtatttaattttctggaggttggaattgtgattatcaaatgacttccaacttggcaccatatgtgggtggatactaatgaatcctttcttaaccttcccagaacttttggagaaatcaatcagtagaaggcgggacaccgaagccatacagaaagccaaaatcctttattcatcctgcatgaatgagagtgagtgatgaagaaaactaaataaaatatttaccatccctatcctttagagttctattaatgttttaatatattgtttgaggaagaagagaactactaagaattctattaatgtttaaaggtgttaaaggaatgattgtgaaagactggattttgactagtcccatcttagttaatgttgttactggcttggtggagaaaatcttatttatatgagttggattctttgggtatcatttactccctgagaaacttagacaaagtcagcagggcaaactccactgtatctggtagagaatccagaagccaggccaagtctggcttgagacagagactgggagggagtgcacctactggagcctagagaaatccagattcccaggcatgccaggttcctgtgtcagcctaacaggcatctttgttgggtccttagccctgtctcaatatcttgggtctgattggaatcagaacagatactggccacttgacctggtctgccttctcaagcccaccacaggaagaagccagtgcctgtgggaagtgtgtcaactggtctaggatttggggtatcatgtggtgagctagaaaagagcaataaaagacaggaatctgaagcatcacttcttcttcattgggtagtgattggctttattgaggcattcctttagttagggttgtaacttagtcccaccaagtattattcattggctgggttccatgtagagaatccatgtttattgtagtgaatatccagcagtttccctggtcagctctcctggcaagaacactaggtatagacagtcacattgaagcgtggatcgtaggtagttctgtctctgtgattatgctcatcccaccccacctcttttacctactccctaacagctgaaattttaagttggagcattatgggaattttgtcttgagaagatgcacttaaattctagtgtgctgatccagtttgcaattctaactttctcttcatatctgctccctttcagaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaaggtataatgaggacccattcatcttctttgctcagtcctagattagccttttggggtgccatcctggggaaagagactcatgctgccttagtgaaataataacataaaacacttttattgaatagtagaatccagaatattcccttctcccggctttgcagaatgtagaccattaccatacaagttttgtaagccttttggaaaactagtgaattagtttcaagtgatctgtgatctggccctcatatgcctactcagagcaagcctagggttcctaaattccagtgggaaggggactgcaggtctcctgttgttagcagagattttctgagccctgctcttgtccttgcctcctcactcccttgatagaggagaaaacacgtgccatgattttttgttcctctttcactaacattttcttgtgcacacacctaaattttagttatcaacttcactctgaatctctcctccctcctttccaaagatacagcaaaacttgttctgttccaagtgcttggttgcgttttctgttggaagactaaccatgtctcccataaagcaatgggccacatggacataccctgaggcatttcacactggtaaaatcaggaggctgtcagaaaactaccaacagctaaagactcaccaatgaaagagctatgcaagaattcaaataacattcgtcaaatagttttgtgctttgatcctgctgggttttgttttgttttgcttccacagttactttgactaataatgaaaatgttattgcatgactgattttctccccaattctgtccttagtcaaatcagaaaatattaatgaaatattgatattcaaattgtagacatgtattgccctcacctcatgcattttaaccttctaaaatccaaatcttaaagttcatcgtttgattgaagctggtcatcgtttgatcagagattggcacattttttgggtaaagggccagataatacatattttagggtttgcaggccgtctggtctctgttgcaactacttaattctgccattgtgtctgggaaagcaactgcagacaacaaaggtatggctgtatggcgggctggcccagtggctgtagttttctcacctctaggttagacaatggaattctcagtaaaaatctttggtcattgaaaggactcccctctactcaggaggaaattctgagttccagagacaactgtgtttctatgtttggtgatgaaatgagccatcttctaatgctatcaggataagatgtgctatgtaagacacaatgatgatgacgacccaactgatctctgtactgtgttgatatatcactcattttttgaaactaggttttaagactatcattatcagttccagaactattatgatgttctttcaaacaccttaagttggtgttttgaagtaagctgaaggctgttttccaaacttaagtttaagtttatacattctattgagtgatagaagatcttgattcacacacagatgaataattgcaaacggtagccattttattatctttctcacctatttctggatctattcaattgaatttattgctttaaactttttattattaaaatgtggtacaaaattaaagaatagaaaaataaactcccatgtatccatcaacccagcttcaacaactctcaaccttctgatgttatgtttctttctgcagttatgttttaatctagagccctccttttttgggaggtggctagaacattttatagcaaattaaaaatatatcattgcatagtaaatacttcagtgcttagctagtggaaaggactattatcacaaccaaaaagataatcataattccataattaacatctaataactagttaattttcaatttttctgattgtcttaaacatgtccttaaaaaaaaaaacagttggtctttgattcaatctccaaataaaaatcacaggtgaacttagttgatatgtctgttttactccacaagggatccccctatttttgttttttaaaccacatttatttgttgaagaaactggagtatttgtcctgtaaactgtcttacattctgaatttgactgttttcagggtaatctaatagctgatgaaagttcttgtttataggagaatcacagcttaaaaatgcagaagaaataataggaagctatctatttaaaaaaaaatccctaaggaaaggattgatctaggcaattatcatcaatggctgctaaaaccattaggtaaatggttgattgggaaattcatgatatcagaccgatatcacctgaaccctaatatcaatgatagcattgctaaaagtggggcaaccagatattgtgtgcctcctggtatcagtaggaagtgcacactatcaccagtgatgttgtcgtgcccccacaattgagcctctagttttaagaggagcttacagaaaacatggggaatagagaaacatggtaaccaatttttaatagcttgccttgtatacttaatattcaattaaactgatcctagaaacactaaaatgtcaatgatagaatactttccaaatgtaaggaggcacccatgtacttattattgctctcttttgtcaagatggcagcttgttccaaactggtgtttgaacattgtttggcatttgagtgcggcaaacgtttgcttaagttctgttcctgtttgtacctttttccatgactgaatattcacacatctgaactaattgccttccctcagatataatataattatagtcttcctgatgacacatttacaagagttcgagcatgtatctggaggtggtaggagaagttttattctgagagctgcatgaaacccattgaacctgataacaaaaattagcgtactggtggctgccaaagttgtagaatttgcaagtgttgcttttttattcatttaaaaatagttaaaactataaaagacaaaatctaattggatgaacatttgaagccccccccacttataggttttgtggaacatagtttgaaaactactggtatagttaaaaaacaaacaaaaaaaataataggctttggtatttaaaagattgaggtttgcagtttagctttgtgatgtactcaccgaatatcctcgtgcaaattacttcacctcgctgatttcacttttcccatgtgtacggaagggtgaattagaatttacttttaatcgtcattgacgttcaaatgaattgacttttgtgacagttttcactgtagatactggtccacagtagcacacgacacaaggttccgaacctactcttcaagcatgacccagcaactggtcaggaccatttggagaatgtttttctttgacatgtggtacccgatatgcctctcagagctcaaactcagtagtgcaaggaataggaattttgtttactcaacctaatatttgacttttagctcccacccaaccttttggtgggaaactgaaccttagtctaggcatttacctcccctcttggtggccccatttctcggtcttttcctagggtattgggaaactgcaataaccagttatctggtttctgagaagaaacccactatggaaccatgtagcctcttcaagtgtgcccctctgatgctgaggtcctgcgactcccattccttctcagatcctgccatgttttggggtgatcagttcctctgctcatgagaattcttgacttcttttgctgcttgaaagatcctctttctgctctgggagaaatccctcttacctgaaactctcttccctcaatgtcgttaggcttccttttccatcgaattcaattttcttcggtgtgcttagcttttctaatcccacaaacccacaggaataagagaagggccttttgggcaggcacagcactgtgggcatccttttgggtgagcagatggtgcctttgggtgaagagacaggcaccctttctaagggttagatatatccccatgccaaagacatgcagtttggccagcaggggtcgctctaatctacacagcgtacttctgcaaagctcccctgtggcaaaatgatacagggtttgctacaggcttaaatgaggtaaaggaattccaaaaataaagaaaacaacagaagttagtgaccaaaaacattatcttgctgcacacgtttggatttattctatgtcaggagatagtatgaggatttaagggacaataaaagacgtgagtatatgtgatcctgaaagagtatttggaaggccaaggatgtcccagtatgtattactagttaatgaagacaacaacttaaagtcatcatctcacaacagcctgcatttttctggctctcagcaaaactcgtaaaaaatggcaaggagaaactccaagaaaatttgaaaagtttcattctctttccttttcctttttttctcaggaactgacagaacatagaattttattttattattgttattttttattgatacgtaactacacattttcatggtacatgtgataatctgatacattcatataatcaaatcatggtaactgggatatatccaataatgggattgctgggtcaaatggtagttctgttttaagttttttcagaaatcaccaaactgctttccacagtggctggactaatttacattcccaccagcagtgtataagagtttctttttccttatatccatgccaacatctattatttattgactttttgataataaccattctgactggtgtgagatggtatctcattgtggctttgattcacatttctctaccgattagtgatggtgagctttttttcatatgcttgttggtcacacgtatgtcttcttttgaaaagtgtctgtttatgtcctttgtctactttttaatggggttgtttggtttttgcttataaatttgtttatgttccttgtaaattctggatattagacctttgtcggatgcacagtttccaaatactttctgccgttctgtgggttgtctgtttattctgttgatagcttcttttgctgtgcagaagctctttggtttaattaagtcccgtttgtcattttttgtttttgttgcaattgttttgggcatcttcatcatggaatcttgcccaaagtaatttacagattcaatgctatttctatcaaactaccaatgacattgttcacagaattagaaaaaggctattctaaaattcatatggaatcaaaacagagcccgaatagccaaagcaatcctaagcaaaaagaacaaagctggaggcatcacattacccgatttcaaactatagtataaggctgtagtaacaaaaacagtgtggccggtacaactacggatacatagatcaatggaagcagcccagaaataaagctgcacaccaacaaccatctgatctttgataaagtctacaaaaacaagcaatgggtaaaggactgtggtgctgggataactggctagccatatgcagaagattgaaactggacccatcccttttatcatatacaaaaatcaactcaagatggattaaagatgtaaatgtaaaacctaaaactgtgaaaacccttgaagaaaacctaggaaataccattccagacataggccctgtactatattttgaagtcaggtaatgtgattctccagctttgttatttttgcccaggatcgctttggctatttggggtctttcgtggttccatataaaatttaggatttgttttttctattttgtgaggaatgtcaatggtattttgatagaggttgtgttgaatctgtaaattgctttcagtggtattgtcattttaacaatattctactaattcataagcatggagtatccttccatttttttgtgtccttttcaacttctttcatcaacattttatagttttctttacatgaatcttttatttcatgggttaaattgattcctaggtgttttatattgtaaatgatattgtttattgatttctttttcagattatttgcttttggtgtatacaatgctgttgattttgtatactcgaactttactacatttgttgatcagttctaatagttttttggtagagcctttaggtttatccaaatataagatcatgttatctctgtacaaggctaatttgacttcttcctttccagtttggatgccctttatttatttctcttgcctaattgctctggccaggacttctagtattgcgctgaataaaagaggacaaaacaggcatccttgtcttgttctacatcttaaaagaaaggcttttaatttttcaccattcggtatgatgttggttatgtgtttgtcagatatggcttttactttttgaggtgtgttccttctgtacccagtttgttgagggtttttgtcataaagggatgttgaattttattgaatgcttttacagaatgtattagaatgattatgtgatttttgttcctggttctgttaatgtgatgtgtttatatttatgtacttgaatttggattttccatttaatttattttttttgagatgggatctcactatgctgcccaggctggacttgggttcaagtgatcatctagcctcagcctcctgagtagctggtactacaggtgcatgccactgcacccagcatatcatgtctattgatttgtgtatgttgaactatcctggcatccctggattaatcccactcaatcatagtgaatgatctttttcatgtattgttgaattaggttagctagtattttgttgataatttttgcatctatgttcctaagtcatattggctggtagttttcttttctccttgtgtccttgtgcagttttggtatcggggtaatgctggactcatagaatgagtttggaagtattcccttctcttcagtttttttttttttttttttggaagagtttgaatataatttgtattgcttctttaaatgttttgtagaatttggtagtgaagacatcaagtcctgggcttttctttgatgggagaccttttattatggcttcaatcttgctactaggtattagtttgttgaggttttctacttcttcatggttcaatgttggtaggttgcatatgtccaggaatttattcatttcttctagatgttccactttgttggcatatagctgttcataatagtctttataattctttgtatttctgtggtctcagttgtgtcttctttttcatttctgattttatttatttgtgtcttctctcttttattgttagtctagctaaagatttgttgattttcaaaaaaaaagccaacttttttcattaattttttttggtgtttttatagtctacatttcatttatttctattttaatctttattatctctgtctactaatttggggtttggtttgttcttatttttctagttccttgagttgtatcattagattgtttatgaattgttatttgaagtctttcaacctttttgatgtaggcttttattgctataaaattccttttcagtactcctttggctgtgtttcatagattttaatatgttgtaatttcattttcatttgtttaaagaaatttttaaatttcatttttatttttttcattgacccattggtcattcaggagcatattgtttaatttccacgtgtttggccaggcatggtggctcatgcctgtaatcccagcactatgggaggtcgaggcaggtggatcacctgaggtcaggggtttgagaccagcctgaccaacatggtgaaactctgtctctactaaaaatacaaaaattagccaggcatggtgtcgggtacctgtaatcccacctactcgggaggctgaggtgggagaattgcttgaacctgggaggtggaggttgcagtgagctgagatcatgccactgcactccagcctgggcaacaaagcgagactccatctcaaaaaaaaaaaaaaaaagattccatgtgtttgtgtattttccaagtttcctcttattattgatttttagttccattgtggtcagaaaagataactgatatgatttctgcttctttgaatttgtggagacttactttgtggcttaaaatatgatctatcctggagaatgttccacatggtgataaaaagaatatgtattctgcagcaattgggtgaaatgttctgtaaatgtcagttaggcctatttggcttagtgtctagtttaacgctgatgtttctttgttgattgtctagatgatctatccattagagtggagtgttgaagttccctatcattactgtattgcagtctccctctccctttagatctgttaatatttgctttatatacttaggtgctccagtgttgggtgcataggtatttataattgagataggcagtatattgctatatctccactaggtccttgcctttttttctggcactaaatggcaccttaagcctacgtttgctttgactctagcccaagatcagagcactcccagtccagatataggggaggtcctaaagaggatatcctggcagtgtggaaaagctggctggcggctagtgtacaggtgacctttggaatgaacctcctatagcataatgctgctgaacagccactctgatttggtgtctcctttggccgagttacggagcagagtttccagggctgggtatggtagtcccacctcccctctttgtctcttgctgtcttcagaaatatatctcccttcaggcactcatgatgccttctgtgggttaaggtatgggcaggtcttctgtcaaagaacccaagatggtcaggaagctggttgtccaccttgatctcactttttccagtgtagaaactatgagtcagggaaaatttctgcaggcttgttgctggacagattggttggaagggcatcatagagaaattttattatcctttgtctgcttggagttttttcacttctctgtggcctcagcaactgattcatccttatatttgagttctgggatattgctggtgagaatcttagtgctgtatatttgtttttagtttcctgtgtatatgttggggtggggagggaagccagcttctgtctccaccaccattttgaaacctgaagtccagactccatttcctacctcaaaatttgtaagctctttcttcttgtattactactttgtcttctaacttgaggtttattatcattggaatgccagttgtaattggagaaaacatttatattttcagttaaatgtgttggatttcctaaaaaacatactttattttctgcttacagtatttagatcagttgtaaatgcaaggatttaaaaaatctcaacgcagtgtcctgattgcttcatgagaaagtcttttgcctcaagagtttgtatgtttctaatgagatttatttgactgaccttattcaatttgttggttggtgtgtttaaaatgttccctagaaaccataacaatctgaaagtttataaaaggtctggtaacctcacttgaattatctaaacttttacaataagtggatttaactttatttcatgagagggaaactttggctttcttgataatatctacacagtttcctttcctatgagactcaagctcaaaagattcttcaagtggtccaaatttaattgaaagccaaagtgtcttaatcataatattgtgtttcatgatcgtggcttgcttaatttttggaagaaatagtggcagattgggaattgcagtaggacgaagccaggaaggcttgtgactttgttgtttcaggccaatgagagagggttgaacaaaataatttgaggattttagcagtatacacagacaagatgggtgttttgaaagtgccttttttcccctgaaacaagagttatgtttttcctggaatttttcataatatcactaattcttaacgtggcctttgtaaaatttgttgtatattaagggcagtttcatggaaaactgtaatcttatacaaatttatgtatttaagattatagtaagacgaaaaagaagctggaggagatgggtcaaaacagtttaaagtcatataaactaatggtatgggcatgtaggattcagtttttattcagatattactaatttttaatttgttgtttagattttgtttcttattattttggcttaatgtttaatgtgtgaattagagatttaatttggaaaaatctactcttcttgagattcattttatttatctttagtcagttgctgatattcaagaaagaacaaaccacagatttagagaaggtgctggaaatttttttaaagtatcttaaaatttacataaattcattttttgtgatgtacatgtctaagttttgacaaatgcatagagtcatgtaaccaccactgtaatcaagaaatagaatagtcccatcatccacccccaaatacctcatgttatccctttgctaagtcaagccctctcctcatgcccaaaccctgttagccatcactttgttccctgttcctgtaaagtttggctttttcaggatgtaagtaaaattcacccatgttgtatcagttcattctcttttattgttgagtagtattccattgtataccacagtttatgctttcatgaattggaggacatttgggttgtttccagttttgggtgatattgaataaaattacatacaggtttttgtgtgactttaaatttttttcctgggtaaatacctagaagtaggattgctggctcttgtgtaaatgtatgttgaactttataagaaactgtaaaattggtttccttccaaagtggctgtgccattttgcattcttaccagtaatacatgagtgatccaacttttccacgtccccaccagcagttgtcagatttttttttccattttaacagatctatggtagtgttttattgtgggtttaatttacattttcctaatgactaatgatgttgggcatattttcgtgttcttattttctatcttcatatgttctttgatgaagtgtctgttagaatcgtttgctcaattttaaattgagttgtttcttttcttatggttgagttttgaggaatctttatgtattctagatacacgtcctttgtcatatatgtgattttcagatattttccccattctgtggcttgtctttttattctgttaagtttctttcaagagcaaatttgttcaatgtcgataaagtctaatttattttttcttttaaggattgtgattttattgtcatgtctaaaaactctttgtctaacccctagtaacaaaaatttttcccaatattttttccagaagttttatagttttaggttttacatttagggctatgattcattttcagttaatttttgactaaggtgtgaggtatgtgtaaaggtttattttctttttgcttatggatgcccagtttttcttttctttgagatggagtcacactctgtcacccaggctggagtgcagtggcgccatcccagcttgctgcaacctccgcctcctgggttcaagtgattctcctgcctcagcttcccaagtagctagaattacaggtgcgtgccgccacacctggctcatttttgtatttttagtagagactgggttttaccgtgttggccaggctggccttgaattcctgacctcaagtgatctgcctgccttggcctcccaaagtgctgggattacaggcatgagccaccacacaaggcctggatgtccagtttttctaacacgctctttgaaaagactgtcttctttcttttgtttacctttaaggtgctgaaagttttttttgttttttttttgttttttttgtttttttttcctgagacagagttttgctctgttgcccaggctggagtgtagtggcgtgatctctgctcactgcagcctccatctcccaggttcaagcaattctcctgcctcagcctcctgagtagctgggattacagccacacgctaccatacctggctaatttttatattcttagtagagacggggtttcaccacgttggccagcctggtctcaaactcctgacctcaagtgacccacccaccttggcctcccaaagtgctgggattacaggtgtgagccaccacaccagcctaaggtgctgaaagttttaattcaagaatttatactatacttttctatcactgtaattctacttatttagttgtctggttattatttgtgtttttatcacttatcctaaaccttccagagagggttctaacatttgcgaaggtttctcaaaacaaaattattatttgattccattcaaataaaaaaaaatcaatgccatatgttattttagagataaggagttggaaacgtctgattaatcaactctatacagattggcattttgcaaaacactgcaatgagaaaaatactggaactggtgataggagacaacgattttagtctgagctctgcccaatcatgttaccttgggaaagtcacaacaattatctggcttttgtttctcctcccattgaataagggagaatagctaataatctctaagatctattccaactgaaatagccttgttgttattcagtgttgataggacctcaaaaggtttagaaaacataaattagaaaagcaggggcaggtctctgatagtttattatatctgtcattgccaaagtgcctatttgcatgtaattctgagtgtactgaattgtttttgtaatggtgacatgagctcaaaatatggctgggatgcagacgatttcatcactcttgttaacatggtacgtaagaatttacagtgctagcagaatgctttctgtttttgtttttacagctggaccaagcaacactctccctggccgtgagggaagactaccttgataacagtacagaagccaagtctgtaagttttactcatattcaactatgtgccttaccaggctgctgtcaggcccattagttctaaggccgctgcttctttattggaaatgagcagtgtggctattcaatgaccatattcccaatgcaggaagacttttattcaggcagataaattccactccctgtctttctagaagtctgctcatcaaggctgtacaagtctcagtactcaatgcccttatctagcttgggagacagcactcccaaatgaagtaacaaagaaatgagcttgcagtcattcattcctcagaagtgcagagagctcactatcaattgcagaaataaagcgtcagaagagatacccaggagacagatggttcccaaattgtactgctttagaatcacttgggaggctttcattaaatgttgcttcttgggtcacagccctggagagtctgacttagacttgaggtagggtctgagaatctatatttttaacaggtgttccaggttaatggaggtttaataagaatcagaaaggatcaatcaagttagacttcttggattggcttagaaatctagcagtctcctggatattggaaagagctggttcatttctgacactttcaatttattttggaaactttattgaacttccaaaggagcctcagacctaggtcccctgggtctatgccgatactaacttctatacatagaaggctctggagggaagctaactaagatgctgggcagctttcttgctgaggacactcaccaaagagggttggcaagttttccttcctaaaagtggacagaatgaacatttgccaatgtggggggagggtgtacccctggtattgatggagtctcagcaaccaggctcaaaatcgtctccccctataacctatctgtcaagtcctaatgattctaccttcaaaatatctcttccatccacttggtccctcttttctatcctgactgctataggtcagattcttgttaactcttgccttgactacagcaagtagccttttaactgttactgcttctccttcatcacattgcctccttagcaccagttgacaagttctgttctcaaagcactgctcctagcatgccttcgctcccaagacagggtctaaattctttagagggctttcaaggctgcctcatgactttatcccaagtcatctttcctatctcatctggatttgttcttcccccaacaaaagcagcttgcccactgtattagtccattctttttctcctaataaagacatacctgagacttggtgatttataaaggaaagaggtttaatggactcacagttccatgtggctggggaggcctcacaatcgtggcagaaggtgaatgaggagcaaagtcacgtcttacatggtgtcaggcaagagagcttgtgcaggggaactcccatttataaagccatcagatctcatgagacttactcactaccatgagaatatgtgggggaaaccacccccatgattcaattatatccacctggccctacccttgacatgtggggattattacaattcaaggtgagatttgggtggggacacagccaaaccatatcacccacctcacaggacccttcactgcgttggaaccagtctccctcaaatgctatgtccccagtttctccgggctagatttttctctcagatcttcagtttccaagcgtgtagcagctttattaaggaagttattttgatgtctttaatgttacagttcataattacatgtttatctccctcactgtttgggaaccagacacagcattattattttttttctgtaccaccctctcctaacatatgcacagagggcctaccaagccaccttgtacatttgagtaggtactcaataaatatgttttttggtttttctttttagatagagtctcactgtgttgcccctgctgaagtgcggtggcacaatctcgactcattgcaacctctgcctcctggattcaagtgattctcccacctcagcctcccgagtagctgggattatgggcatgcaccaccatgccgggctaatttttgtatttttagtagagacagggtttcaccatgttggccaggctggtcccaaactcctggcctcaagtgatctgcccacctcggcctcccaaaatgttggaattacaagtgtgagccaccacctccggccaataaatatgttttgaattgaattaggaatagcaaaatattatttctatttaagacttcttttcttttctttctttcttttttttttttttttttgagatggaatttccctctgttgcccaggctggaatgcagtggcataatctcggctcactgcaacctccgcctcctgggttcaagcgattctgctacctcagcctcccgaatagctgagactacaggcgtgcgccaccacgcccagctagtttttttgtatttttagtagagacggggtttcaccatgttggccaggctggtcttgaactcctgacctcgtgatccacctgcctcagcctcccaaagtgctgtgatttcaggcgtgagccaccacgcccagcctatttaagactcttttcaaagcttgcttactgattcaacaaagatttattaaaggcctcctgtatgctaagtactgtataggtcctaaggtcatacatatagtaagaatagcttacagagtcaaggtataagttagtaaatcttattcccaatgcatgagaaggaggtcatttaatacctgatgcgttgagatctcacaaatatatctgaaatgagaggtgggcctaaggcagttctttaattcccattaagtaaggtcacccctgccccacccaatgacatatgattatccccaaaatgggtttatgagtatgtaagaaggaaattctatatttgctatttgttaggtttcctatcatcgttcctctcttttctcctttttttcctgagctagggagcaggactttgtgaaaactgtaaaaacctgaaaagacacagggctgctgtcactggtcttttatttcttagtgtgaaggtgggtaaattgagttgcaagagaataaatcacacctcccaccattctttatggatcaggcctcctgcttttagaaacagttctttcccattgttttattaaagcctcacttgtctggaaagaggaagtctgacctttaactttctattcttgtctcatttggagttatttcatgtatccataatatcgacggttgccagaaaactagttctcttgttgcttgatggctggacatctctgtctgtcatggaaacagtactcaagtagccgtcactctttttttctcccaaagtgttatatgggtgcctggtattgcataatgcctgcaccatactttgagtacagagtgaaaataaaagacatttatttctacctgctattttctgctcttccatgtctctcaaacatatttcctaagaagctattgtcatggtcactttgttctttatttcttacagtatcgggatgccctttacaagttcatggtggatactgccgtgcttttaggagctaacagttccagagcagagcatgacatgaagtcagtgctcagattggaaattaagatagctgaggtaagtcttcactgaaaatctctttctttcctttactttcttttcttttcctttactttcttttcctttccttttattaaaggcagtatatcctgaatgaaaatataaattgcaaacaaataatagcgttttgtgtcattgcccattgggcccaaggtagaactaatagcatcccctctaggaagtaacaaggactgtgacagaaaagctcctcattccttccacctccctggtttaagcccattcagtgtccatacgttgctcagctgtggccaaagaatagcagcagagagaccctctgaccgtttttcctggagaaactcatgtttggcttaaatagaagatagatgtttaataaatccttagtaatctggcttgaatggaaggttgcttttaatccagcccatgttttatgctatccccactcagagtcattctggcttaagttctgggctcagggaaatctgtccaccaatactggatataaaagttggtatagaaataggtaggacatgctggtaagcatttttaaacgacctttctggtattactttgtacctgcccctgtttttcattattttcttgccctactttaatgaatatcattgtgtcatatacatgacacagaactacatgtctatgtaaattaccttaacttcttgttggctcattgtagagacaaaaagatgtaaaaacaaacttgtgggcaaaataatgagaactcctaaatggttagctttgtttatggaataacttttttctagaagaaagaaagtgtaaaaatctctctatatgttcctaggccaagagggaataaatgtggtaaaatctgcttctggggaaaccctgtagtgaaaaaaatgatactttttaccaagaaagttttgcgtatgtgttgggaatcttttacaagagaagttggtaaaaatctcgagatgaataagagtccaaatgttgattggttttgtttggcgaggtggtggtggtgtgttgaggtatggagtagggatgaaggataagggtaaggaggaattggtctctctctctttgccgtggtgatgttcgtgtatagctctctccaaactcctacttgcagtgcaaaaagttcattcctgcatgtcacctttgaagactgtgaagactgctgcagatgtttcgaagtccaggactgtgcctctgagccatgtctagagtctgtctgaattctctttccaggcacataggaggcccagggctctcatttggactaaaactctgaaacagcagggaaggccttgccctgagccagggatttggaccaaaaagggaactaaaaacagctgggctgaggcaagactgggaattgtcaaaaggctaaatgaagtgacaaatctattgtgtggaggggagtggctggcagagagctgaaaacagctctgaggccaaagggctccaacttggggctgtgagactccgagggcggaggagggattggtggaagaggagtgtggatatcctctgaggcaatgattcacaccgagccaggaggctgtttgtaagttacatgtggtctctcctgtggagggtgaagaaagggaagctaaggacactgaagcatttagcaaagaggggccagacgtctgccagtcagccctctgtaatttttaccttgaaaaatcactgctagtaatgctcacttccatatcttacactacacatcactaggtacttttaaaattagtgggatacatagtcctatggaaacttctgaagctgggaagacaagacagtccagcccagccaaatacgtccttgtaattacaaccagggaagcatatacttaaccaatccagctagagagatgtgtgcacaaggagaggttttattgatggagtagcccttgtgattggaaccaagtggagtgtaattggaaaggcttgctagatgcagtgagtcttgggcagtcctgagtcatagttcaaaccatggaggtggtgatggtggataggagatgcaagagtcggagagtcatgtgtgcagtgggaaggtggcaagtttaatgcaagggaattagatgatggaaggcccgaaggcaaagtcatgacgtgattgaggggtggatatgtgagctactgctggtcaatggaagtgattaagatgatccttgaggaagataatcattgctgctgttcttaggttaaacatagtggaggctagaagctcagatttggtgttggccaaatggccaagagcatgagtattaggaattgaaagagtatagagccagggctagagagaggcaagttttgaaatgtgtgtccaggcggtgactaaatccatacccccagcaatggggctagggaaatctcaaggccaaagagacaagaggggaaatgagggaatgagctgttgacaaaatgatcacggggaacagtggcatccagatagtcttgtgttcatcagtgaaaatttgcccctagaggtgaagggatggtctgtggttcatgaaatattgaaatcattatctggagaccacaggtgacaatgggatgtttacctcaatgtccaacttaagtttgattgtcaaaattgagccagcaatagattttgcccatccacattatagattgggagggagatttggggtagttctttttgtactggggacaatatttcacacagaggaggatatgaaagtttattttcttaatcctgcctaaagtgatgtctttttttctcttccccgagttggggaccacaccaaagccttgaaaaactttataatactatgcagatgttttggcacatgtaggaagtaatcatacagtaagaaatggttcacttgaaaaaaaataacaaaaatctcttttcaacagataatgattccacatgaaaaccgaaccagcgaggccatgtacaacaaaatgaacatttctgaactgagtgctatgattccccaggttggtgaaaactatccagaaaactttctctcaactcatcattttagaagggattggatttcatctctgtgtaaatttgtgtcttgtaaaacctgctctcagtcttggttatcatcatctttgtcaacaatcacataaaatatcccttgtctgtgtattgggatgccttctgttacagggaacaaaacatctttccaacagtggcttagaaacttaaagcctatattctcacatgacaaaagtctagacataggtaattgttggcattggctcagctgtttaacagtgttgtcaaaggcccaagttctttctatctttccatcctactgtgtttagtgtgttggctttttgacttcatgtttgatgactcatggttccaaggtatccatcacagctccatatatcacatctgctgtcagagcaggaagaaggtgaaagggccagtgatgtgtctaactcttttactaggaaaaacaaacaagcctttccagaacatctccagatgtcttccctttatttcttattgagtaggattgggtcacatggccactcctaaccacaggggaggttgggcaagtgagtaactggttttccgtttcaacagtggacacaggcaaggaagaaaaggttgggaaaagacttttagagtagccaatctaaaaaacaccatatggtgttttaggtaggatagggatgctctgaagaatggaggcatgttactttctgtgtttttatttgtttttttttgagacacagtcttgctgtgtcatccaggctggggtgcagtggtgtgatcttggctcattgcaacctctgcctcccgggttcaagtgattctcctgccttagcctctcgagtagctgggattacaggtgccggccaccacacctagctaatttttgtatttttgatagagatgggattggccaggctggtctcaaactcctgacctcaaatgatccacctgcctcggcctcccaaagtgctgggattacaggtgtgagctaccatgcctggctgcatttactttctgttgctgcttatttcctcttgtgtttttttttttttttttttaaaaactgtgtcacagagacaaattatgtactggggcatctgtttctgtgtgtatgtgagagtgagggagagtacaggacagagaaagggagggagggagagagaaaatgtaccgtatagaggaagaatttagaaggaggaagagaaatgcaggagagaaggagggaagagtatgggaggaagaaagagtatagaatagaggaagagtactggacagggagagagcagaatggggagagaaagacagaggggagagttcaggaaggaggaagagtactggagggggccaagggagtgagggtgcatattactgtgttagtgtgtgtgtgggtgtcgtccagatgtagatggtacagaacacatgctccatttgtgattaagacaataggtcaggccgagcatggtggctcatacctgtaatcccagcacattgggaggccaaggtgggtggatcacttgaagtcaggagttcgagaccagcctggccaacatggtgaaattccacctctactaaaaatacaaaaaaaaaaaaaaaattagccaagtgtggtggcaggtgcctgtaatcccagctactcaggaggctgaggcaggaaaattgcttgaacccaggaggcagaggtaacagtgagccaagatcatgccactgcactccagcctgggtgatagagcgagaatgtctcaaaaaaaaaaaaaaaaaaaaaaaaaaaaaaaagacaataggtctggatggcaatgatcaggagtttattttctagacttgagtagttgcatcttgaattattaggtgtgaaatcaaaagaaatgaatgatgctcaatctactctatctgcctttcttacttgctacctaaccgagattctctcattctgttttgttctctctcccctcagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagtaagaactttcacatgaattttactgtgacttttgtgttttctttaaattataagggcttcccttctcacatcctttgaaaactgtttttaaagaatgttacatcaaaagagtcatagggaaaatcccggtgtcctttgtgatgaactggccaaaagcactgtctggtgtaatttacttgctgcaatgataacaaatgtttttgccctttatttctggtctttctccatgctgttctctttgagatcctaaattgtttatgagcttggggagctagtcatataatgatgttattttctaaaatgtctgtgtgaacatctttttttttccccagttcattctcaatcttttgctgcttttttttttttttcctggttcctttttaaccattaagtcactttctggcaataaactaaagtaactgtattgagaagacacaagaccaccttgagagtggtagaaaaattgcacggataaaacaactttaggaactgccaggtttttcttattttaaagaatgttttagaatttgttgctttgctagtttattgctacaaagaaaaatcttccaatattccaggaaggagaattttacaggttccttaaggcattcagctttgactacagaaaatgaatcacagagcttacaaaatgaatcaacgagtttacaaaacactttactgagttaattgctgggccatgattaaaatcacattttcttatttggactcagacaaggctatgttgccagaagttacgttttttaaaaaaggcacaacagtccttggaagaaaatgtagcatttatcccctacggaaacacttagacacctgagaggagctgctgctctttttaagatactttctgatgataaaagtaatctgtgttcactgaggaaaacatacagaaaaaggagagaagaaacaattaatttacttaaaattctatcatttagagataagccaggattctttgaaaatgttctaaatggaaattgaatctagaggtacgtaattatattgcagggtagagccttgctccatggaccaggaatgtcagcagcatcacctcgggtgcttgttaaaaatgcagattccaaggccctcctccattgagtctgatccagtagagctggaggggaggccaagtaatctttattttaaacaagtacctcagaagaatcttatgattaacttttcttaggggaggggaaggggatcactgtattagaaaatttctttgtaagtacttcctagctctcaaatactataaaatatgacccaaacgattttctactcatatgccattgagttacggagcacattttaaattttggtggtaatttccattgaaaggtggagtttggcctgctttagattcatccttcacctcgtgagtcagtttcttctagtatctgtgttaaaagagtaggtacttctgaacactgattgattttacttccaaaaaagcctaatttacaatcaggggatagattgggatttggtttactgtattagaaaaagcatctctatcgtgatgattttacttggtaattgcaggacctttcataacaatggaaaagagcatgattggagggagattttactctgattcttgtcaaaatgataacttggacaaatataaacgtagagaacaacagtagaaaaaacatagatggaaaagtcaccttagatgttatgtacacatacaacttcatttaaaaataaggacaaaaattggccaggcgcggtggctcacacctgtaatcccagcactttgggaggctgaggtgggcagatcacttgaggccaggagttcaagaccaacctggccaacatggtgaaaccccgtctctacttaaaaaaaatacaaaatttagctgggcgtggtggctggcacctgtaatcccagcgacttgggaagctgaggcaggagaatcgcttgaacccaggaggtggaggttgcagtgagccaaggtcgcaccactgcactccagcctgggtgacatagcgagactctgtcttaaaaaataaataaataaaaataaagccaaatcccaaatctctttcacacagtttatccctcaaccaccagtttataaaaagcaacttgtgttctgcgtattcttgtgagatttcaatacaacgtacacatcatgagaagtctgacagcattttatttgcagactatggtgatgttttttcattgatgatcgtgtttaatcaccactcgtgtagcattacagggctacttgaggaaaagtcttcttgggttcccataattgccatattggtcaggatatgccagttgctataaccagcacctctaaacactcattggctaaattgtaccctctgctcatggaacagtctgaacatgggtgtccctgtaagagagctttcttctaaatagtgacttaggaagccagactcctttcatcttatggctctgccctcccttggatgtttggcatcctctctattcagctggaggatggagaaacagagagggtggaggattgtataggttttggtgggaaggcctagaagtggggtatgtcacttctacccataatccataagccagaactcagtcttgtgactcatctagctgtaggggagactgggaaatatagtttagctatatacccagaaggaaaaggagttggagtttccctagacatgcctttatcaaagagcctatctcattttcttgaaatgaccacttttctctcaatggcaaatacttccctgctccctacctctatgacactgtgagcacctcatggcaggcactcttttttaatttttaatttttgtgggcacaggacatattttgatacaggaatgtaatgcataataatcacatcaaggtaaatggggtatctatcccctcaagcatttgtcctttgtgttacaagcaatccaattatactgttttatttatttaaaaatgtacaattacactatttttgactatagttacctgttgtgctagcaactactaggttttattcattctttctatttttttgtacccattaaccatccctccttccctccttcccctctgctatccttcccaacctccagtaaccacccttctattctctatctctatgaattcaattattttaattgttagctcccacagataagtgagaacatgtgaagtttgtctttctgtgccaggttatttcacttaacattatgatctccagttccactcatgtttctggaaatgacaggatctcattcttttttatggctgaatggtcctccgttgtgtatatgtaccacatttttaaaaatccatttatctgttgatggacacttaggttgcttctggcaggctgtcttgtgattgcttttttaagtgttgtgacctagcacagtgcttctcatgtagtagacactttaaaaattctagaagttaaccagataccccatcaccaccacaaggaggtgacatatgaatggaaccccaaaggataaagaggaattttctaggtagggaagaatagagaaaaggggatggtaagcatcttcagtggtggaaccaatgtgaacttgggtgttgcctgcaaggcagggggctagagagctgagaggccagcttgggctcaggatatgtagaggaaaagcatcagatgaatgttctgaggatccccccacctcctacctttcccttggaggcaccattgaagaaaaagccagccaagccttctcacattgggcatctctgctgtgcctctgtttcgagaatctgcctataaaaatcatatacaggtaatggtgatgttaaccaccactatggttaacatctttgatctttacaacaattctatgcgttgttcccactttacagatgaggaagctgaggttaagtgacttggccaagatcacacctctaagaggaaacagagctgagattctaaatggggtcaccctcatttctatgtcttgtctctttttttccataaatgtcttggtgtgaaaagagatacttttcagatgcttcactgctcattttggagatgctagcgtattgtaccctcagctagttagatattgctagctttggcaattttcctgcaatgttcagcagttcaaagccatcctgtgttggtgtcagctgttcatttcttattttttatttttatttttatttcaataattttgggggaacaggtggtgtttggttgcatggaaaaattctttagtggtgatttctgagattttggtgtacccatcacctgagcagtgtacattgtacccaatatgtagtcttttattgcttaccccctcccactctccccctgagtccccaaagtccattatatcattcttatgcctttgcattctcgtagcttacctcctgcttataagtgagaacatgcgatatatgtttttccattcctgagttacttcacttagaataatcatcttcagctctatccaggctgctgcgaatgccattatttccttcctgtttatggctgagtagtattccatggtgtatatataccacattttctttatccattcgttggttgatgggcatttatgttggttccatatttttgcgattgcaaattgtgctgctgctataaacatgcatgagctagtatcttttttgtataatgacttcttttcctctgggtagatacccagtagtggtattgctggatcaaacggtagttctatttagttctttaaggaatctccatactgttttccatagtggttgtactagtttacattcccaccagcagtgtaaaagtgttcccttttcaccacatccatgccaacatctgttatttttttgatttttgattatggccattctcacaggagtgaggtggtatctcattgtggtttggcacttccctgataattagtgatgttgagcatttttcatatgtttgttggccctttgtatatcttcttttgagaattgtctattcatgtcttttgcccactttttgatgggattgtttgtttttttctttcagctgctcatttctcaattgctgcttctcccttcttatattactcccactgccagtctaggggattaggcctctttctctgactgagtggctgtggggacagtggcactgactctttggtaggtggtgcatggtacagaattagagcaatgagatcctccagtggtggtggtgccaaaccacaccagcccttgcagtccaagggggtaggtggccagggagggacccttggaggaatgagctggaggctgcctgtggggaacaagagctggtgtttgaggtggaaaggggggtggggtaaggaggtagtgatgatccctcatgttatgtgcatctcttcctaactacatgttcggtgatctcatgttgatagtttcaattcaactatgggggattttgacaccatggaaattggcaaatgtaacaaatcatttttctttttcttgacaaggcagttggcaacctttactagcacatcactgggtgaggggcactatagacttctctccctttctgtccccctcaattctcctcctcactcctgactcgaggctgcctcagacacttcccatctacttttatctgaggagtaagagtgggaggaggagaggccaaggaaggttggcatcaggaggagctgacgtgatttcctcttgcaggccagggctggatccatggagatcatctgcgccaggactgttttcttttgttgttgttgttgttttgttttttagcagactggcctagagcaaacccttggagttttgtcaaggaccctgtaagtattcctgtctttagttttattttcatataaagcaagtacaatgtacattaaagtaagatgattcttgttgcatgttcccaaaggatgacctggaaaatgtgctgttatgtggacctctcctgggggccagctcttctgagagtgatctagggtcttgctagccaaagaatggcctacagatgagcagcagagacattactggggagtttgtcagaaatgcagactctcgggctctgccccagacctactgaatcagaggctgaaattgaataagatccccaggggactcatatatacattcaagtttaagaagcactgatgtgggatttaggaagtcctagttgagctgtgtgtgcagaacgatgcggagatggagttttcctagaccagctgttttcaaacctgacacgcctcagaatcccctggagggtttgctaaaatacagtctgctggccccccaccccacagattctgattcagcaggtctggcggtaaggcctaggaattttctaacaagttctcagatgacgctgaagctgctggctcagggacacactttcagaatcactgccttacataagcctctaggcagcctgtaggaagatctctggctttgagaacctttaagaagagcctctgtggctcacttcagatagtatgaccaagacgagcaaatgcaagttctggaatctgaaaacccagatgttagtcctggatttgacacattcttggaagtaccttgacctcttacctttgttttcttcacctgaaaataaggataataataataatcacctcacagcactgttagaaatatcaaagaaggtattttatgatctcttaaatgtgatacaaatgtaagctgccactacaatttgagtatcccttatccaaaatacttgggattggaagtgtttctgattttggatttattcagattttggaatatttgcattataattaccaattgagcatcccaaatctaaaaattaaaagaatcttccaagtcagaggctttaggaaatgatttcatgttgctctctttgtggtgggtgctcttttgagatgctttgcctttctctgtttgatttattgccacttggggaaattaccatatggctgaaaatgtgtttttttgggaaaaaaggatattatgtgttattttcaaggactgttgctgactgtgatttttgctttttgatatatctgagcattaggtgacagtgattcagtcattatggttatatctgttcctggcgtggtaatattagcactccaaaactgtgctccatagcattctgtcagtgtatttataacacactgaagaaactcatcagtgccattgtctcgctgtgtgaacttctcagcattacagcttccagcttgcagaggtctggttgttatgctatcacctttgtaatgccttgtccaggaagtcctcgtaattctttttgtgcccacagatttctgtgaagcatctttgttggagtgttttggggtctctgtgactggccaggaaatcttagctaaattagaggctttggccaggcgtggtggctcacgcctgtaatcccagcaacttgggaggccgagttgggcggattgcttgagtccaggagtttgagaccagcttggcaaaatcatgaaaccctgtctctaccaaaaatacaaaaaaaaatgtgctgagcacagtggcgcatgcctgtagtcccagctacttgggaggctgaggcaggaggttaccttgagcctaggagatcgaggctgtagtgagctgagattgtgccattacactccagcctgggtgacaggagtgagtgaaactctgtctcaaaaaaaaaaaaaaaaaaccaaatagaggctttaattcatcactatctggcatagggaaaagcatgcaggctttagagttagacacacctgggtctggtccggcctccattgcttattacagtggttcttcaacttggcctcacattggacttagctgaggagatttataagcaatatttatgttgggtcccactttagagattgtgacttaattggcctggggtggcctaggcatgtggacttttaacaacttccccaggtgactctactagtttgagactcactgaatatgtgatcgtgagtttacttaatggttctaagcctgaagtctcctcatatgtaaaatgggtataataacatctctcttacagcagcactgtgaggatcataattaatgtgagatgcctaaatgggatgatctcaggggagctggaagggcccctgcttctcaaaccccagtatactttgccatactacatcttccaccaccaccattgggccccctaacaacttccctagttattctggctcatcaccacccctttgagggaatatcttttgaactgatgaaaggacatctgctggctgttgacctccttctcgtctccacctatggatccagcatggttcacatgcctggtaagaggtattttagagacaaagaacataaagtccttgcactaggaccaagatcggcccattaatgtgctagacaccatgacctggtcgctgtctgcatctccccagtgtggctggcctttctgcccacttccttgagtgatgatcctgttcaccatcctctccaacatatcagccgattccaccattatttagcctgtccagagttcacgttcctgtttgcaacaccaaagccttttaacctttcggcatgcttctctcatgaagcctactcttaaccctcagtttgagatgtactatccttacagtgaagtgtctggcacatacttttgggtgctagtgtctaccaaatcattatttatgcacttgcctcatctcccctgctcagctaaaagcttcaggaaatcagggactatccatctccccagcacagagaactgttagtatatatgtgggtgctcaggatgtgttgattgagtgaatgaaagaaagacccttatgtactgacagtgtgtcccttcaattaaacaacccaattacatgaacaagctgaaatctgaagtcctgtgttcccagctggactttgagttctctaactgtaggtgctgggttcttacttctttacgttcctcatggcatctggcacaatacttggccaacaataagtgctcagtgagcacttcttgtcctattaaggagtggagatgtgaatgcaaaagagccaaaggaatgaccccaaaccacttagtggcctcaacagagatgggcaagggctggactttgctgattagtgcagtggtgtcttaggggaatgcgcatatcctaacaagatccattgggtctgagaagaacattttagaacttctatatctttatttaaatttaaaaataattaggctttatacagagtggtataatggactttggagactcagaagcagggagggtaggaaggggatgaggcataaaaaaactatagattggatccagtgtacattacttgggtgatgggtgcactaacatctcagacttcaccactatacaatttatccatataaccaaaaaccatttacatccccaaaagctattgaaataaaaaaactttataaagaaaaataattacactttattgagttctatattgatggctatggacccttcatttgatctgtatggaacatgtgagaggggcactgtcaccctcactggcttgttttcattcaatatattaaaaataatctcagctgatacggtggctcacgcctgtaatcccagcactttgggaggctgaggcgggaggatcacctgaggtcaggagattgagaccagcctgaccaacatggtgaaaccccatcagtactaaaaatatagaaattagccagtcgtggtggcgggcatgtgtaatcccagctacttgggaggctgaggcaggagaattgcttgaacctaggaggcagaggttgcagtgagtggagatcgcgccattgcactccagcttgggcgacagagcaagactccatcttcaaaaaaaaaaaaaaaaatcttgagcggtttacatatagctgtggatttatgaattttattatctagtttatctagtttactacttacaaagtagacaagtggcttaaaaattcttgcaggaaacaggaattgaaatgattattgatgatgtaagcacaagagaacagctagaaattggcagaagtgacccttctcccaggctggtatgccatgttggttagccagatgacaaaagaaatacaatggtggtctaacaagaacaaggacaatggcaatctgacaaagacatgtcatacatttttgaaatagtcaagaagactctaagaaatgtggatttatattcattgtcattgttgtattaaccaaatcctatatggacactgtgtcttgaagaattaacccaatggtgtttgaagaattaatgacttttgaagattttaaatttcattttacctcatcttttgaaatttctgtttttgtatttgttaaaaatattcctaatatattagtctattagtatatctctatagaaattaaacatccatgtattgggtgtgtatgctgaaaaatattttactagtaggagcgcatgtccactgtgtcagaatgtcatacaaatgagagtgtagtttgttcttgatgggcttttagcatcatcatgtcatattgctctcatgtgattggctcaccagaaagccatttcaggaatgtgtgttattagtcaccatggtaatggcacagctgggaggggaatggatcattaaagatccatcatcactattgagttagaaattaactgagatcacacattcttctgaggtcaggtcatcttttgcttatagaaaaaggcaacccttaaaatttaacagatttttaaagatatgtattataggcattacatgagcttatgaggttgttcatacatttggaagtgaaagacaaaaccctagaaattgactatttgtcaagcattttgttatttatttgaaccctgcaacaactctgtaaggtagggatcatcctcattgtatgaaaaataaagataaaatcacagaccttaagtgacttgtcgaaactcacatatttagtaagtatagaatgagggtgcaaaattagatgattggtattagccaatattttgctgttagtttccaaaggcaaagaatacataggcattgtatcaagtcacctaatccagtaagtcctcacttaacatcatcgatagcttcttggaaactgtgactttaagcaaaatgacagataatgaaatcaattttaccataggctaattgatgtaaacaagagttaagttcccatggcatattcctgctcacaaaaacatcaccaaacttctaaataaagaccaaaacacttctaatattgaacattgaatacatgtgagctatgcgtacatttaagaaagacaaataaaagcaagtaagataattttttttgatctttggaacccattcaatgtttttgtagacatattcttttttttatccttgttttcattttttaaattatactttaagttctagggtacatgtgtacaacgtgcaggtttgttacatatgtatacatgtgccatgttggtgtgctgcacccattaactcaactcgtcatttacattaggtatatctcctaatgctatccctcccccctccctctatgcagccataaaaaatgatgagttcatgtcctttgtagggacatggatgaagctggaaaccatcattctcagcaaactatcacaaggacaaaaaaccaaacaccgcatgttctcactcgtaggtgggaattgaacaatgagaacacttggacacaggaaggggaaagtaagataattattaacccagttattctagttcagggttgcaggtgctggagcctatctaggcagctcagggcaccaggcaggatccagccctggctaggatgccatcctgtcacagggtgcagtagctcaccatgctcactcacactgggaatgtgtagacacgccgattaacctagcaggcacatctttgggatgtgggaggaaaccacagcacccagagaaaacctgtgcagacttgaggagaatgtgcaaactctacacagacagtgaccctggcccagaattggttttttccttatcaactgtataacaaaaggatgttgaatgaaatgatgttattcgaggatctgctgtaatttgaaggtactcacaatttccagacacgaaaggctgtgtaacagtggactttataccctgagagtgaaagtaaaatgttcactctgagggctggagctggaatctttccttcatctatctctgttaggtggtgaaaagcaagccaattttggttgtgcttattgacattgtatcatcttatgtcatttctcaagtgaaagttctgcatttttgtatgagtaagaggtccctcgatggagctttgccaactgtttctctcaagatgttctgcagagcatcagatattgacctaaaatacaataaatgggcatctctctctgttaacaggaccattgccaactatttggtgtggagaatggtttattccagaattccaaaccttagcaggcgctttcagtatagatggctggaattctcaagggtaagtttaagaagattgcagtgttacatcgctggataactttacatgctggaatagtccatatattaactgatccagtaaaaatcatctttagggattagacagggggagtttgtagcccaagctctattgtttttgtgtgtgtgtgtgtgccttatttatttttatttaggtataaattacatatggtaaggtacactcaagttttactttgatgggttatataaagatatttagagaaatacttgaggccacacattgttttcaaacttccccgtcttattagtgtattcccattttcccccagagtttttaactgggtcactgtaattatagttttaacatttctttgtgatatatttgtaactatcttttattctcagtattctgaatatttaaaatgtgcatgatagagatattggatggtagaacttcattttcaatttggaaatggaattttgtcttaaactttgcctataccttccatctttgaatctatcctctgctaggtccaagaggctccaatttagttttcttgctcaactgtctgagatggttttcctccacctgctcacctggctctttatttatttatttttattagagatggggtcttgccatgttgcccaggcttgtcttgaactccagagctcaagtgatcctctcacctcagcttcccaaagtgctgggattaaaggcacgagccactgtgccgggcctcacctggctctttaacctttgcttctctcccacccttgctcgtctcccagtttgtacccatgttactctcacctttgtttttgaggcttatgtctgactaattctcctaccactagaggccgtaaggattttgtatctttgaaacagtttttatttttctatcaatttaaagttaagtgaatggtgaatcttataagctatgatttcattcaagaggcattttagttattagaggaactaataagtatagaaattcttagtgggccattactctggaagagtagtgcaattattttggatatgctttgaccctataaagtcactagcatataaagttactttagggctgggtgcagtggctcacacctgtaatcccagcactttgggaggccaaggcaggcaaattgaggtcaggagtttgagaccagcctggccaacgtggtgaaacctcgtctctacaaaaaatacaaaaattagccgggcatggtgtcacgcacctgtggtcccagctactcggggggctgaggcaggagaattgcttgaatccgggaggcggaggctacagtgaactgagatgatggcaccaatgcactccagcctgggcaacagagcaagactccgtctcaaaaaaaagaaaaaaagtcttttttacagagaacagcataaaacaactatatatatatttaggtcatattgatgggttaagatacaaaacaagtaggttttgtgtgtgtgtgtgtgtgtgtgtgtgtgtgtgtgtgtgtgtgtgtgtgtttgtgtgtatttttaactgctacgaatcacataaaagatgatgcccagctgctttccacccctactgtgaagagaatgagagaggtgtaagaagcactgtgtgaacatttaaggttaggtatgaggggatgtttcttgagcacgaagtgctaaatataatattgaattgccgaagaaggttgtaggatctctttctctagaggttttaaaaatagattcatcgcttacctctgagagaggttaccagaaatcagaggaagaatagatgaaattaagccttaatcccattcctcaaaacaacctgggtctaacattgtgcaaaggacacttctgaccaccattctcagggcctcccttcctccctgcctgcacccccagcttccaagggcaacttacactatatttatttctctgcttttattcccaagagtaaacctctgacccaggtcctgcttgggaaacttcttacttgtttgtaaatgttttcttgcaatggtataattgggacagatgggcaaagcatttacatctgtattttgcttgtttatcagtgtgttttttgctgtgacacaatgtaaatatgctccctgtgttgttcatggtgggccatgttcttctggtctgccttgttgagtgtgctactcggagcaaggaaaccctcactgggcaggaactttgatcacccactgattctagaccttcttagtggaactttagttctcaggagatattaaatattatctagacacttggatagcatcctctcatgtccctgctaactgcagaaaagtgataccattgtccagattctttgtttaatggggaaaattgggaagaaaggatacatatattattttaactgttaaatcactttcttttcttcttcttctttttttttttttttttttttttccagacagagtctcactctattgcccaggctggagtgcagtggcccaatctcagctcactgcaaccaccgcttcctgggttcacacaattctcccacctcagcctcccaagtagctgggattacaggcatgcaccaccgtgcccggctaatttttgtgtttttagtaagcacggggtttcaccatgttggccaggctggtctcgagctcctgacctcaggtgatctgctcacctgggcttcttaaagtgctgggattacagatgtgagccactttgaccggcctaaaacattttcatttagtttgaaatataatggggacaagcagaatttttttcttcaactattttacctttgcctctactatctgatgcatatatatgggttagggtgtgcagtgttttgtagactgttttcttcaggttgtttgaattgttttcagccatgggttttatccaaatgaagtttaatctggatcaattatctcccacaggtaatccaggggaccacaactttgctgcctcaatgggacaaatgtgtaaactttattgaaagtgccctcccttatgttgttggaaagatgtttgtagatgtgtacttccaggaagataagaaggaaatggtaagtggtactccccagctagcaaaaaataatggcaatttagccagatctgacaagggtatattcaacaggctaatgtcagccttccaggtggtagtggcctgtgggtattgtcttcagattctttcaacttctaagtgaaataggaagaaaggtcatcaaacgagagtgaggatgagttagcaggtattgaaggttagaggagagagaaggtgtgtagttttccaggggagtgggagagtgaataaactgagggaatgtagtatagctgcttgagggcaggcatgtccagatgtaggtgaggtttgaggtattgaatttaaagagggactcatcactgtggcaacgtgttcttctccatctgtttcaactgcattggagaaaagggtgtatttttttttctttcagctttattgagatgcatttgactaataacaattgtatatattcgaagtatacggccgggcgcagtggctcacacctgtaatcctagtactttgagaggctaagccgggcagatcacttgaggtcaggagtttgaggccagcctggccaacatggtaaaaccccatctctactaaaaaaaatacaaaatttatctgggcgtggtggcaggcacctgtaatcccagctatttgggaggctgaggcaggagaattgcttgaaccccggaggcggaggttgcagtgagccgagatcgcgccactgcccttcagccaaggcgacagagcgagactctgtctcaaaacaaacacaaagtatacaagatgatgatttgacatacattgtgaaatggttgccacaatcaaatgaacacatctgttgtcacacttatttaccattgtgtgtgtggtggtgggggatgaggacacttaagatttactgtcttagcaaattcaagtatacaatacattattagtaactatagtcaccatgccatattttagatccccataacttattcatcttagaactagaagtttgtaccctttgatcaatatctccccatttccctgcccccagcccctggcaactactgttctactctctgcttctatattttaacttttataaagattctacatataagtgagatcatataatatttgtctttctgtgcctggcttatttcacttagcataatgtcctctggctttatctatgctgttgcaaaaggcaggattttcttcatttcttcatttttatggccaaatattccattgtgtggtacacacatgcacacatcgcagtttccttatgtatttatccattgaagggtatttaggtttattccatatcttggctattatgaataatgctgcaatgaacatgaaggtgcagatctttcttccatatactgattttacttactttggatatatacccagtagtgggatggctggattgaatggtagtcctatttttatttttttgaagattttccatgctattttccataatggctgtaccagtttacattcttaccaacagtatatgagcgtttcctttttttccaggaatattttgccaacacttacctcttaaatttttgatcatagccatcctaacaggtagtgaagtgctatttcattatggtttgatttgcatttccctgatgattagtgatgaaaaccttttcataaacctcctgtttatgtgtcgtctttggaaaaatgtctattcagatcttttgcctattttttaatcagattattcgttttttcactattgagagggtgtattttgaattagaaacatggatttggccaagttttttgtctgcattttatttttgatgaattatattttacaaatgtcatgaagtaaaagatccaggcatgattaataataatccgtgtagtcaataagatacaaatatatgagcagcttggatgcaggtggtcaataaacactgaattaaagggcaaagacattgtaatgtcatgattgttcaaatgattggtatcacgtagtgatacataataataccaaatggttggtattatgtatcagtacatagtcattattgatacataatacatgattatgtattatgcactgaagtttgctttgcaataccatatctaagtacatttgtggcaggccaggtctcactaacacaggcctccatcacaactgtcccagcacgtactgagtagctaggttaaacattaaaagctgattgaaccactgcccatatacaaagcctggaatgtaacaaagagcccaccaagagttttgcctaggcttttcctggatcttgaagcatgacaagataatgaatgaattcttaacaggacccttttaggattaaacaagttttattgggggtctgaagaaactccacaggcctccacaaacaagtttactggggtctaaaggaactccccaaacctttatgatttagcaggagacaagataagggtaattacctcagtacctagacccatttagattaagtaaacttactgaggctccagaagaaggtcttcaagactcacacctagttatagattaaaagaagttaatcatttatgtctttcgacgattgcacactttcacgtagacatatagcttagaaggtatatgagctctagaaaactttgtaactttgagttggtctggtgataatttccaggctttctccctgtaaccagtggcagaaaataaaactctgttcttccccagttcatttgcatctcgttattgggccgtgagaaatagcagcctgaccctcagtttggtctgggaacaaattgacctatgttaacttgtttttactgtctaactatgagactttatgtttgaacctgaaagttcccttgcaaataattccactgaggaattaatggcttatttcaaaatactcagtattctcattgcgtgttttcttttgctctttggtcagagtaaatagattgagatcttatcagataatcacagtagtaatattataatctctgggaaggctataaaaacaattaaaggataatgaaagatttaaaaaaattatagcaggttttttggcagtagaagaattttaactaatatgaaaagtatgtggattaaacttgtttttctcagttttggtgtgaaagtcccttttccttgtgtcagggtatgacattctaaaataaagttaattttggcatcttcccccttattttgatgtacgtgggggtagtttggtagttaggcagatactcatctctttaacgtaaaattgtttgcctcccttgtgctgaagctgtttgcctcagggaatacttaggttggaaacttataagagaaatatctggccttttatagcctttttttttacagggctcccatccaagaaccacctggaaccactgatttacttgaaaaacattcagtattattagctacagtctaaagaaaaagaaaaacagaaagatccccaaaggggcaaattccagagaccctaactcagatggaaggctgccattgtttatttaccaaaaaagtttgttaagcaaatgaatacagtcagaagcttaaacttcaggtatgtctcaaatttacatgtgtacataaatcacgtgagcatctgcttgttaaaaatgcagattctcattgcattttaacaaggttttttttttttaagttgtgtttggggtaggacccaagaatttgcctaacaaggttccaggtgcgactgctgctgctggtcgtggaccacactttgcgcagcaaggtcttctcatgattcatttgtttgtaaacagcaccaaaaaaaaaaaaaaaaaaaaaaaaaagcctcggtgactcacaagagcaggccaggccagttgacatgaatagcagtactttatttaccaaaaccggttacattagtgcaagtaactgctttaattttcagatcattgaaaatttctgtgattcagattggtttaaatggactgtgaaaaaccctgcgttaggacctccaggctttatcttttgaaaactgatacctaggttttactaagagactcccgccccacttctcctccgtgtctgttttgagaacctcttgatgacagagttggcccaactgcctgtggttggtaccctctcttctaaagagtgagtgggagagagcagttcacattgaggtttcctacctatcagtgttctcctccttttcactggggaaaacacataattctatattactgtttcactaagacttcctacatccaactgtgcatttggacacaccgatacaccaacgttctcatactcattcacacacacaaccatgggaatttagcaaattgaattagaaatgagaagaatagcatgtagaaaaggagagtccttcaacagaaagccaccaaaagaggtcatatagtacaatcccttgcctcccagttagcaggacagagccttaactcgtgagattggctgcaagtgttgctttgtctttgcagtccaaagtagcactacccaattgaactggaatatgagccacatattttttttgagacagggtctcactctgttgcccaggctggagtgcagtggcgtgatctcggctcactgccacctccgcctccctgtgttgggattacaggcatgagccactacccctggcctccattgacttttatattaacattttctccctccttacctccctttcttcccccattccccagaactaaaaatcataactttgtctatcagaggacttctttaattttttatcttatttagatgaagattatttataattttaaaacattccattagctaagcatttaatattacttttgtggaaagttacatgaaagtgggactcccctagagaattgatgatatatcatcactgtaaatagagatgatgctctcgttccactgtgccaagccctgatccatatgctcatgacctaaatggcaggagagaggattagttgtgttcaggaaggatgtctagagttatcacttgctaattttcccctttatttatttttattttttaatactcttgtctttttctttttcttttttttttttttgagacagagtcttgctccatcacccaggctgaagtgcactggcatgatcttggctcattgcaacctctgcctcctgggttcaagccattcttgtgcctcagcctcatgagtagctgggattacaggtgtgcaccaccaggcccagctaatttttgtattttttttgggtagagatgtggtttcctcatgttggccaagctggtcttgaactcctgactttaagtgatctccctgcctcagcctcccaaggtgctgggattatagacgtgagccaccacgcctggccttgtttgattattattattattgcttatatctgtaatgtataagtaagtgccccaggtagatactcatgtccatggagggcaggtgaaggttccaacgaaggccagggaatgaagggattgtcaccatgggcctagttgtgactgtgatggtcaggacatattggttttaaaatgtggtgatgataataacagtagcagttagctttcactgaggtttaactagctgtctggtattcttttaagtgctttcagtgtgtgaactcacttatcctcacaatgaccctgttactgctgttagtgccctcattttccagatgaggaaacaggctcagagagttgaagtaaattctctggagtcatatagcttgaaaatggcttaggtagggttcaagcccagacaatctacatggaaaccagtgttccattcccttgcttatctctgaaggcacttgaatctttgccagttttacgaatatgaggagaccagaaccttcttagtggcttatcttataattacccttgttagcaaattattctaatattaagatcctaaaagggcatacatttcatattttttaacatttcagaggtaggaaacagttggaataggtttggcttccagtatttcaaaattttaaatataaatatagtggaaacctaattcatatccaaccagttgacatcacatttttgtattcatataattctcaggagaaagacggaaatgataagaagcaagctactattgatttaatctaagaataaccttgcaggtatatctttggctcagtctacacactgagctcaatttctcgtattttgtacatacgtcattctaaggagtgatccctgatgtttgcagtggtaacccaaaggctctgtaagatttattatcaaagtttaaaaaaaaatgtttaccattctctactaaggcggaaatgtgaatatatacatcaaagaaattttttttctattgtgttgatgggaaaaaaggccttgttgctgtaactctagtttctagaaaattcagtaaagctgaagttcccatgtgaacattttggctgggctaagttcttctgtataaaccatgtcttggtttgtttcattgtagacactatgtccccaaactgcttatctttattcatatatctcatctctgccagtaggtattttttgctgctccctcaaattttctgcatttttcttatagagtaaaccctgctaaagcaaataattattttgacacttgttaaaatagtaatgaagactattcaggactattgcaagaggtgtcaagtctattgcaacaggggagaaagattaggcccaactctaaatacagcaaagatagctggagatttatagccagtgaggagaatgagggggtcagtggatggaaaattatgaagaggagacatcacgagcagggaaattcttgttaaaccaacttgacaggattcttgtggaaggcaggccaaggtgatcaggatggggattctttctaaagtgacttagcaggattcttgctacaactggactagacaggcttgtcgaggacaggatgggggtgggaggctgggaggagggtaagggcaagacgtacttgagaagagggctcagaggagcctgactaaactttggtcaaggagagagtctttgtcagctctcagatcaaagctaaagtcactgatctcctgtcatatattaaaacattctatatgcagaaggttaatctagttaaagcagagcaaatctattacacttcagattcagattttattaagtgaagaactaaaacttgactccctatgtagaacaattcactaatttctcctgcactctagcagctattctatttctctttaaagacattgttcatgtccccaagtaatgccatggatgccctaaaatatcttccattttttctgagctgctctctgcctgagcaattccagtagtaattcttatcctaagaaaagaattctcctcccaccccatactgctacatctggtgttgaagacttaaatacccacgtgggtccaattgcagtggcggagtttgaacttgcaacctcaatacactagaagttcacctcattagtgagctaagataattgaattgatgtactgccattaatattctttaagttctccaattccctcgctcactgtttctctcagtggttgagtaaatgagatgtaactataacgttgatggcagaagtcacatgaaactcagtgtcatgcattatagcattgcccttatactgaggagtttttcgttccttgcaaattcagctgctcacaaaggttgttctcagtaaagccactgtacagataaagacaatggtcccttcatcacaaattgtgaaagaaaggatattctctttggctactaaatgcccgtttctgtttgtctagtaagtggtgttggttattattatcaagatcactttccagagaaactttgctgaagacctgtccaaattaaggcaaaccatgatgatttggttttttaagggctttttaatatatttataaaatattgacctaatatagaaattacatctgattttctgcaaagttgcattgatagctcatagcccagctctgctcttaccaacatgggcaaatcagttaacttctttgagcttgttttcctgttataaatgatgcaagagtttctgttgctttggtaatgctgtgtaacaatcaatcacaaagcctcactggcatttgacaataagcagttactgctgatgcatctggagtcagtggtgggcccccatgcagctctgttgattttggccaggctggcttgaatttctgggggttggctgatcaaggttggctttggcagaggtgattggaatgactcggctctgcttcatgtgtcctgcttccttcagccggctagcctgtgcatgttctcatggtgatggcagaagttcaagcaagcaagtagaaacatgtgaggtctcctgagacctaggctcaggacaggcataatgtaatatctgcattttgttggccaaagcaagtcacaaggccggtccagatttacagactagggagatagggtctgcatttttttttttttttttttttttgagacaaggtctggctctgtcccccaggctggagtgcagtggtgcgatctcggctcactgcagcctctgcctcccaggctcaagccatcttcccactttagcctgcgagtagctgggactacaggtgtgcgccatgatgcccggctaatttttgtattttttgtagagatggggctttggcgtgttgtccaggctggtcttggactcgtgagcttaagcgatctgcccgccttggcttcccaaagtgttaggattacaggtgtgagccacctgtaactctgcatttttaatgagaggatctgcaaagtcacacagtaaggggtgtggataaatgaaggagtatggcattaaagctgtcagtgctgtgtatcacaaatagggataaaagtatacctccttctttcatttgaggtgagagttaaatgatataatctatgtagaaggcctagcataatacctggtacacaaaaagtgctcagtgaatgtcatctactcttattgctaatattgccatgcctaatgttaataattaagatagaatttataatatcaacttcctggcacagctgtggcaacttctgcatttagattgcctctttttaatttatcatagagtgagggaggtgcctggggggttttgctgtcgctactcctccatacatgcctagtatagtagctttcattggaataaagatccttttcatgttagtgccctggccacattccagaacccaccctatcatttaacgccaagtctggctcatacaagagtctcatgaaattactcatgaaattactcgaggagccaaatataatttctttttcttttttttttttttttgagaccaagtctcgccctgttgcccaggctggagtgcagtggtgcgatcttggctcactgcaagctctgcctcccgggttcacgccattttcccgcctcagcctcccaagtagctgggaccacaggtgcatgccacctcgcctggctaattttttgtatttttagtagagatggggtttcactgtgttagccaggatggtctcgatctcctgacctcgtgatctgccctcctcagcgtcccaaagtgctgggattacaggcatgagccaccatgcccggccatgtaatttctagaataggtccagatttcataaccctctgcaggctaaatcttgttacaacaaatatcatccggtcccaatcgtgacagctcatttatgcaatcttcggtcaagtaacatccagcaaaacaagtaatttagatagctcattgggaattcttttgaaataagtatgaacacttactcttgtccttgtctttgagtgtgctgccacgacgatgacacattggctcacctttcttgtttgttttctccatttctggctagcattgggcagtgttgcctttgccacatattatcagccacagtcttgtcaagcagatctggtcagacctatggaatgtgaagaccctttattagaaattcatttacctaaagaaaacatttatgccttccaacagatctgaatgttggaagtgaccagacatagttacttgctggggagaatttacccacagccaaaggctagactatttgagactgattgacttgtaaatattattctggtttctgatccatcctctcttaaagttggaaagtggaaaacaggaaaagatgagttataaaattagaacacagcctatatgttcatatccagcaaatagaaatataaatatctacctgagtcttatgaatatatacctttagataaaaggacatgagaaactcctcctgtaccaccagaataacccactttatagcaccaaataatttgattttttcttcttttgccaaaatgtttaatagctatgtaacactgctaatcctgacaaactgatatgatttattcactcacttggctgccagaaacctcagcattttctaactatccttagttcttctggtttaaccacatgtcccacttcaatataggtcactttttacttattttgttgccattattttttatcaggagccaatccaagggcatttttataaatagttatagtataagtaattaattaatgaatatttcatatttattggtgcattcatttatttaatgtctgtgtttctagtaaagtgacaattgccagaaagaaaattttaagagtccccctgagattaaagcctatttcttcagggttatccacataaattattaacaacgatttccatttttcacattccaccaatcagtggttacaactcaagaaaacttgccctgttctagagcaatgagaagactggaaacattttaatctcatggtttttttccagatattataacttctaagtatgttaaagaggaaagcctactcaacattatgccttttcgttaagaattttattaacattaaattagtttaaggttaatgcccataatcaaccttactgattttttttctttttcctttcttttctttttcagaactcctagcctataattattcctactagatatgtactatatttttaaaccattccaagctgtttgtcatgtaccatgttgacatcacctatcttagaatggactaggctaacttacagagtcacttgatttccactaaagtttgtgtttggtagtaggctacagtcattctggagacatttgctgtgaaccttgtcccctaatataacgatggattttctattcactgataagttctactcatggattcaggctttgaattactaaatcagagtaggtctctcttttcaaaaatgacttcacctaaaaagggtaccatgcattttttttttccctttttcagctttcatgttgttaaatctcatgatcatatctgcacagcaccatattttctatgagtgagtttgttaatattttctctttatactattggaataactgttatctgttagcatatatgaaagatatttgattcaatttcaactctgctaggtgccaattgaaggtttcaaaaagcataaattgatcagcttgtatttactgagcatctgctatattttagtattaggtatgaatgtgagatatggactcgtgaaaaatcatatcacatgagatatgaaatcataaaactaacaaaattttaaattagcagaatacttttttgtttgcttacatattcatgatctcatttgatctaaatcatggttcctgttctcaaagcttatgggtcttgttagggagaccaaataaatataaatgaaaagacaacaattaaacacacacctatgtattattctgattttaagcctcacaggaactcagagagggaattgaaagtgtgggtttaagtgtttgggattcatgggtatgagataggatttgagttgccttgtgggatttctttattatcagggacaaagctttgaagaaaactacaaccgatcatggggcaaactaatccctccttaaagcaatgttggcatatgtcccttcaaatgtattaatagaaccatcatgactcatttatgcaaagtacagaattcttatgtctatgtgatgggaggaagggtaaggagagggcaagaggagcaggagagataatttataatttgctaagataggagcatctcattaaagtaaagccctggattgaagggtaacaagtgcctatgcatatgtgactcaccaatgtctggtgtctgatgtagaactctatgggcaaaatcctggggtgcaaagaatgaaaaaggaagaacctatttttagataacactggttgaggaagagaactaagaactgcccatagatcaaccaaatgaactgtatttttatagtgtggatccataaaatctgaaatagttgtttttttttttttttttttttttttgagacagagtcttgctctgtcacccaggctcgagtgcagtggggtgatctcagctcactgcaccctccacctcccgggttcaagcgattcttgtgcctcagcctctcgagtagctgagattacagttgcccgccaccatgcctggctaatttttgtatttttagtagagacagggtttcaccatgttggccaggctggtcttgagctcctgacctcaggtgattcgcccacctcggcctcccaaagtgctgggattacaggtgggagccattgcgccctgcccctgaaataaatagatatttaacaaaacgttgctttgcctagagggctcttaccctgaatatggcagattttaccaaaataacacttgagttaatttttatatgttatattttgacctttgactggctctaaataaatatttcctatggataacttcaccttaagacttccactttaagggatttctattaatgttatatgctgcctggttgaggtgtgaggtccaagtttggtgaagaaatactatttctctatttttttcttattttaaaattacagcaggtttttgacttgactgaaggcaatgttattatgtgatgctgtagagtagtctaaagataaaaatcagaagtgttcagtgatttatcttcctagttccagcatgctaaaataattatttctcttatttgcattgacatgtcaaccaatgaaattaatcaccttcaaagattttccttgttcttgaagtctgctggggtagttcaacaccatttcacagaaaatgttatacaataaatctgtaaagtctgccaaaaaaaaaaaaattgagaacctgaggtgggggatggtgtggggagtggaggtgccagagaagacaagggcaaagagcagctgaggctcatgggaaaaaaaaagtgatttacccgcgttttgacaaatgtgagagggccacaaagagtgagttaccgaagtgtggattcagggaagacagaggtggtgggggcaggggaggaggtggaagaaaaggcagaggagggaggaactggcatgtgaataaactatttgtcatttttcactctggcagtgggctgaaatgtttttgcctctttttattttcatttagaatgccaatcaatgggttacagacaaagagctttgaaaaccttttcttatttatttatttagagacggaatcttgctctgtcgcccaggctggagtgctgtggcgcgatcttggctcactgcaacctccgcctcgcgggttcaagcaattatcctgtctcagcctcccaagttgctgaggttacaggcatgtgccaccacacctggctaatttctttttttgtatctagtagagacggggtttcaccatgttggtcaggctggtcttgaactccagacctcaggtgatccaaccgcctcagcctcccaaagtgctgggattacaggcgtgagccactgcacccgccctgaaaaccttttcaaaatgcattaaattttaatgaatttgatagccattttaatgcctgggagatgctggacagggagggtcctatgaaaccaagctgcttagagagaagtatctggaaacactcagccccattttaataatagccacatactccataaaaatacctcaaagagaacaggagcaaaatgaccttaagattcatcataggaatccaaaaattccaaaatttgctgaagatctttttagcttggagagtgcttatttttttgataatttattttaaaacctaataaaatgttttgcttttgtacaccttgtcccaaataaatattttctttggacatattcaactttttattatttattgggtgctttctattattgctacatcctggccagggtattgagagggaaccttttattgtcctctttgtccctatctgtaaatatagtaatccccccttatctgagacagatactttccaagaccccccccaacccccgcccagtggatgagactggggatagtactaaactctatatatactatgtttttcctatgcatatataactatcataaggtttattttataaagtaggcacagtaagagattaacaccaataactaataataaaatagaacagttataatgatatactgtaataaaagttatgtgaatgtggtctctctttctctcaaagtatcttatggtattgaactcatgcatgtacttcctatgatctgtctgataaccaagatagctagcaagtgactattgggtgcgtatatacagggtggagatgctggacaaacgaagggtgattcacatcccgggccagacaggctgggatggcatgaaacttcatcacactaatcagaatggtgtgcaatttaaaatttgtgaattgtttatttctggaattttccatttaatattttcagaacacagttgcccataggtaactgaaactatggaaagcaaaatcgtgaataagggggtactactgtacttctcttcctagtaatatgttcatgctgccaggatgcacatagccatgtgcgaagaaatataattttttagataaacctccctttaagcagaaggtctcaatcctatttcatggagaaaagacccacgtttatactaggactctctcaaccttctacatctaatctttagattcttctgcatgcctgcctatcattttaatcttctctcctctcataagtctgtctcatatctaaggtgaatccttccatatagtctctggatcccatcacctcctttgccctctgagacaccactcatggcttgctttgtcccatattttcagtctcttccttttcgctggatcctttctattggtatttaaacatagtcaaatctctcagcttttcaacaacaacaaaaacagtaggaacagcattagcaagcatatgcatgaaacccaaactccaaaccctcagacccttcccttaaccctacctctacttctctcctatctttgctttttctccttcatagacaaactcaattaatttgtccagacttgctgtcttcgcttcccacacactcttcatcccactagtttggcttctgtccccatccctctttttcttccaattttctcagtcttattgaatgacggtgtttgccaatatctttctgaagcctaggaatgaatctgactctctctacgttcctcactttcccacataaaatgagtcacctgtttccattggtttggtctctaaatctctcctttgagtccacccacttctttccctccccattgcccctccctaatttgggaagatataatttctttttctctgtgaacgtgatgggccagccaatgcatgttgctacatgatgagtccctaaagacttagggccaggtgtggtggctcacgcctgtaatcccagcactttgggagactgaggcgggtggatcacctgagctcggaggttcgagactagcctgggcaatatggtgaaagcccgtctctactaaaaatacacaaaaattagctgggcatggtggtgcatgtctgtgatcccagctacttaggaggctgaggcagaagaatcgcttgaacctgggaggtggaggttacagtgagcagtgagccaagatcatgccactgcactccagcctgggcgacacagtcagactcattctcaaaaaaaaaaaaaaaaaaaaaaaacttaggcatgctgataggcaaaagatctagtccccggagatttccttgtcattttaacatcctcctgatgtgggttttctgtttgaaattgtgacttatgcatctctcagttgattccctttcactccctggcatttctctctgattttgggagggatcctctgttgttactagaggctctgagctctccactgttattttagctctttggtcaggtcctggctctggtcctcattagctgtgtcagcttgagcagatcatagactccttgacccttaatttccttatctgtcaaataaatggtttcccctggtctagtgggtctcagccctgactgcacattagaattacctggggaactttttaaaccctcccaatgcccaggctggacctcagaacaatgatactagcatcccgatgcccacgacgcaggattttttattttatttagaaattttttgtcagtattattttttttttcttttgagactgagtctcgctctgtcacccagactggagtgcagtggtgtaatctcagctcactgtgacctctgcctcccgagttccagtgattctcctgcctcagcctcctgagtagctgggattacaggcgcctgctactacacccagctaattttttgtatttttagtagagacggggtttcaccatgttggccaggctggtctcgaactcctgacctcaagtaatctgcccgcctcagcctcccaaagtgctgggattacaggtatgagcccctgcggccagctctcagtattttttaaagttcctccaaagattctaatgggcagacaaagttaagaaccaccgacttaatgatttttaaaggaccttttgctctttgctcttctagcagtttgtgttttatcccaagttgaagtttctcttcttttaatgtttttaccaagttgggaagaaatagctgtgaagctcccccgacccccttccatctgctgtttgttcttatttacatatgatggaacccagcccactgatttatagctctggttccctcacaactgttattgaactgaaaacatagctgaaaacttattaaacagaaaaaacttattttgagcttcatgctgacaatttattatagaaccaaggaaacatttcaacgtctttccttctagagttaatgttaacaattgatttacaaccccatgctctcaaatgaaaaagttcattctggggccaaacccagtgttttttttttcttgggtgtcccattgagaaagccaaagcatctctgcaggagaactggatttcgaggggtttgtatccatgaacaggcagggcctcctcacattgctgccggtggcctctaatgtgacgtgtcagtagcccctttcctccagtcctctcttctggtccacagacaccggcagcaaagccaggcacgtacatcctcactatgggtgtggcctcactgttcaaatgctttgcgataggtctttcagaagtccacctttcggtagcagccccctttagacctaccattttattttattattatttttttagagacaaggtctcactctgtcacccaggctgaagtatagtggtacagtcatagcttactgcagcctcaaactcctgagctcaagtgatcttcctgcctcagcctcctgagtacctaggactacaggtgcaggcgccaccatgcctggcctttaaaaaataattttgtttttatagagatgaggtcctcttgtgttgcccaggctggtctcgaactcctggcctcaagcaatcctcctgcttcggccttccaaagtcctgagattataggggtgagccactgcccctggcctatacctacccttttaaattggaaataacaagacttttctgagctgccaaggagtagagaggagagtaggaagatgatatagaagagccgaacatttagtttaacccacggaactaaatctggaaagaactggggtcctgacataagtgtgattcatattggtgaagtgtcctttggggtgctaagtctccctgcccgtttctctgtgttaacagttatctctttcaactgttcactttcttctgcaatacctatctgaaatgcacagcccatgcctttcctgtctctctcagtcctttattaaatgattaaaattagttggcaccttgataaggatgaactagtttagtagctacagacaggtaagttattggtttgtcataatctatggtgaattcctatccctgtatacccgtataattcattttatagctgggccaccacattattctcatggaaagaaatggttttttttttttaatgttttttattttttggagacagggtcttgctttgttgcccaggctggagtacagtggtgcagtcatggctcactgcaacctccacctcttgggctcaagcaatcctctcacttcagcctcctgagtagctgggactaaggcatttgcctctacaccaagctaatttttatattttttgtagagatggggttttgccatgttgcccatgttggtcttgaactcctgggctcaagggatctgctcatctcagcctcccaaagtcctgggattacaggcatgagccaccatgcccagctaatttttatatttttggtagagatggggtttcaccatgttgtccgcgctggtctcaaactcctgggctcaagtgatccacctgccttggcctcccaaattgttgggattacaggcatgagccaccatgctgggcctggttagttatcttttagtggtggaaaaaagggaattttcctggaaaaagaagtgttgccagagcatggagtcaagctgaaagaaccccttacttaccatgttgagtaaagagtcatttctcatgcaagccaattttgttccagaaaacctcgactgaagcttcttggctttgacgttccctctttgggtattttcttgtagatggaggaattggttgagggcgttcgctgggcctttattgacatgctagagaaagaaaatgagtggatggatgcaggaacgaaaaggaaagccaaagaaaaggtaaggattccttttgatgaaaaaaaaataagacttctggtttaatggatgttcatgcttgacattgactgtgtagttggtttttatattgactgaactgttgactctgaatgaccccagagttagctgtctgcttttggatgaatacatagatttttgtttcaccaggaggtaagagaaaataatacctgaatttttcgaactgcattttcaaataccttgtaattcggcctttcctttctcctaattgctgtctgtaagaggcacatggcttgctgcctggtgaattgtgtcataaaccatcactggatatggcagaatgcagagcagtggggagtcacagggagcagctggaacaagagcccctaagacaccaaaacgaagaaaacccatattggccacatgtccttctgctctgtgcatgatgcatgcaaatgtcctggggcaaatcctttcctgtaaccaagcatatctccttcccgacccatcatttggcacaaatgacccaaatagtatactgataaactgcagaccagtgttctaccattgcttaggactacaaacgtatttcctaatagaagtggacacttgctgggccttgtaaaattttctgatactatgcgacacgataagggaacaaaggagaaaagtattgacagccatgctgtttaaaagtagaaaacgggctgggtgcagtggctcacgcctgtaataccaggactttgggaggctgaggcaggtggatcacttgaggtcaggagtttgagatcagcctggccaacatggcaaaaccccatctctgctaaaaatacaaaaaaattagtcgggtgtggtggcatgcatctgtagtcccagctactcgggaggctgaggcaggagaatcgcttgagcctgggaggcggaggttgcagtgagttgagatcgtgccactgcactccagcctgggtgacagagcgagactccatctctgaataaatgaatgaatgaatgggatccattttgaattccagagattctgatagagctggaattcaagtgggtggagcatacctgctagactcttgatggatgcttctctgcagctgagcatttcttgtatctagaggtatttttgaaagcttcctgagtataacaatcacctgggttgcctggacgctctggctttctgggccccttcccagcaaggcctgggttaatggatcatggatgcaggctgaacagctgtcactttagccagtctccgggtgattgttatcactaggcaggtctggggaaacactgcctggagtcatactgagtcatactgagcacaaatatttttgcctcagcgttctgggaatgcttaaccttgttgaaatgagaacacgtagagttttagcaaggatattttctagtgctttaaactcatggtactggagatggataaacattgccatagatacttttgtcagtagatgtgaaaaggcgtttgttcagtgtttataatgaaggaagaactgggatggtgggtggcaaggcagcgttggaggaagacaaagagtaggtttgattttttgtttccccttcaaaaatctgtcaaagctgtcctcagtcacataaggcacaggctgatgaaggcaagagcacatgggctgtgatgggaaactctccagatggtagacaactttcaacaccaacatattgttgttttatgaaggcttcatttatttgctgagctagcttgtggtatgtggaacaggatgtgtcttgccctgggcagttgagcgcttagtgtattaagggctctttatcctcgcctgaccccacatgaaccgaagaggtgcttgcatgaattagtacaggaccaccagggtggagggtggggtggagtgtgtgtgtatgtataggtgttgggggtaatgtgttatgaatagctggatgccaggggaatgttctgggaagtgcagtcagttctttgagcagtgtggattgcagttgcctcagggagctcttctgagtggcataagggagtgggtgcctcacagttggcccttctcggcaagtggcccatgggtccttcttgaagcaggactattctcagttcttctaatattagacatgttcctgtttgcctcccgagttgctctccagtcttctattttatttcaatgagagctgtcagtttttcttctaaaagcgttctttgaacactctgctttctttgagctgagttcaacctgccaggaactctgctagttccacgacaggtacaaatatcaaaggcaaattggatctcacaaagttccccgactgtatcttgcatttcagagttcagagaagtttctttaacgaaatgcaagaaagatggatgttgttgaagcaatttcagcagttctttgaagtgggtcctttcctggaccccagaagatgtaaattttttttttttttttcccctcaaaattaaatgaacatgcagttcttaaaatgacctctgggtggagctcgtggtactcacaaagaacactagcggcgttgaaagcttttatgcagctttctactccggcgttgtttttgaaaaaaaaaaaatttcttgccctttttctctgctgtcctcgatttgattgccttttaatagtcaacaagaaaggagagactttgcctaataattccttgaatcttagatggaaatctcccactatcttagggttttgtctttctgatactgagtagcccctgcattaagaaaggatttgcctgcatttgaagtggaggtgaataactcgcctgctcttcctggtatgacttggcactgttctttgggcatgtgttgtatgcagtgtatcacccaggcggaagatttctcatcaataatagtgcccacactgggccaatgctgagtcacttggcaacccattgggaaagctggaaaaatgttctgatttgtgaaagggagaagcttttctttccctcaccatgaagctctggaccgcagctaattacagagcctcctaagaagtgttaacctcagcattccatagtgaccgacctcctgaaccgggcaggtacagaaagctgcagtgttctgaggcctaataccttggcttttgtagcaatgacctcgtctcaaaatggaagtgtgtggatgtggctttgttgtactctttgctaggggtgttcactgtaaaagataaatgaggatgcctctgctcccgtgaagggtaaatttgttttctctgtctccctgccttttcctgctcatctcttaagaggtcacgagtagtttttgtattgtgaaactgatggtgtaggtttcaagtggaaatttagtatcgtgaaataagcaccgctttttgtttaggattctctgttccctgcaagcatgtgctcttattgtaaataagcagcaaaggacagggcatctgttatttttctggtgaccacagctgttgaatgagtgtcaggtgataaaataatgattttaggggtgtcttctggaggatttgcccttgccagagtagaagaggaggatctcaaggtcgctacatcaggattctgactgagacctggcaggagagcgtcagatcaggaggagcaacttcctgagcttggcttatctccagctggatttgactatatagccaaaaagctggatcccttcggaattatttgtttgtttgtgctctttgcccctgggacctaagtttgtcaggtcacatccaaagaaaaatagcaggatgggactcacagggaggtggcatcctaatgatgctctgagggagtggccttaaccttggccacagcaggtgcagagaagtcggctgaatggtcctaaatttattggcatgtgactctcacacacaggctttgagtgaggtggtgagagttttcttgcagagggcgaaacagaggtgtagcccacttctttggctttgtctctaagctctaccaggcctaggtactggacttctcccaggtatgcggtcagggctctgcttatatccggagcctggtggttctcaaggtgtggttccagaccagtagcagcagtggtccctgggaactcattagagatgcaaattttcacatccccacctgctgagctctgggagtagggctcagtgccttgtgttttacctggtgattctgctgcgtgaaaagggttgggaacccctgtcttgtccttaccacttcacagcacacctgcctgacttccaactgcagcctcctgcattttggccaagagcattctctccctgctacagcctgctttgctactcataaagagggcccaaaggacggggaatgaccacaccttcctcagaagtcctcacccaacagttgatgggagttgctgtgtgtggcccccgctccctcatccctctagtgcgtgttccacatgggctctgggagcttttccaatgggctagagctattatactagctaagatactcgttgctgactgcctttctttctctacatatttcctctttctcctaccagtgtttcttttgctgcccaaatgaactgctcgcacttgaatccttgtcttagagtctgtttctgggggattcccaactaggacacagcccctgggggtatacgctttcccagtgcttccttgcctgtaaggcaacagcacatttcaccgagtctggttgctagcactgcttcagcagactcaatgccacaaacatttctagcacaccaacagcatgccaggtgctgagccgggattcggactcagagatgagcagccacagtcccttttctgcgggggccttcaggctcctaggagagaacaggaggccatggatgcagggcagaccaggagaagtgttaggtaacgtgatggagacgaaaggggtcctgggagtctaggggagctcaaacatgacatgtgagggtgccttacttgggaagtgcctactctgcccctttctctcttcctctgtggtgttcccacaccctgtcttgcagccttgtggcaagtcttcctcttccttccttactaatcccaactctgcatctggctgtcacttccccttgataccttcactcctgcttcacctcactgtgcattttaaattgtttcgtaggagaaaagaaacagaagggctttcatcaaactgtctcctgccctttccagttacagattctagcacatttgcataaccgctcaagaatgcagtcaccctgcgtctggcatccactccagggctcaccagggacagtgactggtagaccagcatggaaaccgcgggctgtggctccctcccatgtgccaccttcccgagcttgtcccttctctttggctctatgtctctctcacacacatgcaggccaagatggcggccttcatacttgtatctctttcctctcactggcctcaacaggaagtatggtatagaggtcaggagtatagacaggtgagagactgcctagtttccaagccaacttctacaccttattgactgtatgaccctttggaaattacttaacttcttccaccctcagttttcacatccataaactggggagattggtccctgtctcagaagatttgttatgaggattaaaagagccactgtgcctaaagtacttataagaatgcctggagcatgagaaaggctccccaagttgtcagccgtttggtccaaactgctgtgcctctgggaggggaggctttggctggaccagacggtgagaggagggatatttgtgagcagcccctgctgagagggtgttggaggggatgcatttcttttctctggattttggattttgtggttttgaacaaattcagtattgtcgttgtgatatatattttaaacacaaaagtaaatatctggtataagtgggagtttgatgcatatatctatttattttttcgagttaaagtctcgctctgttgcccaggctggagtgcagtgttacaatcatagctcactgcagcctgaaactcctgggctcaagcgatccacccaccttagcctcctgagtatctggaactataggtgtgtgcccccacccaccttagccttctgagtacctggaactataggtgtgtgcccccacatccagctaagtggttttcttaatttttttttttttttttggtagagatgggatctcactgtgttgcccaggctggtctcaaactcttggcctcaaccgatccgccagctacagcctcccaaaatgctgggattacagtgtgagccactgccacacccagccaacatatatttattaaaggcatagtacatgtgatatcttaccggagtgattttccatgctctagagcctcatgtaaatgtcatttagggggatgctttaggtcattcattctcacacttgagcatgcatcagtgccatctgaagggcttgttaaaacaccaattgccagccccacccctagaatttctgattcagtagtgctaaggtggagcctggatatttgcatttctgacaagttctcaggcaattctgatgctgctggtctggggcctgtgctttgagagctctaggtgattacaagtgaaaatgtccttatgccaagcctgtgttaatagaagggtataatgttcattaagtgattgtcttacctcttactggagtccccttttcaccatttctcgcaggtgggtcccctgagtgagtactaggacacccagaacccagccaggccacctactctactgttgctgtctctgctaaagagccctgcttgagagagatccaaaggctctttcttggtcatttctgctccttgactccacatctgtccccaggaactacccaggttaagtcttccacataaaagcccttccaacgtttgaagatgtttaaatgtttttcttttttctttattttattttatttatttatttttttcgagacagagtcttgctctgtggcccagactagagtgcagtggtgcaatcttggctcactgcaacccctgcctcccgggttcaagtgattctcctgtctcagcctcccgagtagctgggaccacaggcatgcgccaccatgcccggctaatttttgtatttttagtagagatggggttttgctatgttggccgggctggtcttgagttcctgacctcaagtgatccgcctgcctcagcctcccaaagtgctgggattacaggcatgagccaccgtgcctggctgttttttctatttcaaataaaacacctttagtgtttctcacattaaattaaccaacattacagtcagactggatgttctaaatgcttcacaaatattagctctctcaatgccataatatccgtatgaggtaggtactttttttttttttttaatacagatgaggaaactgaagcacagagagtgtgagcacacttacccaaggtcacacagctagtaggtagaagagctgggattccctccctagaggtctggtttcacagtctgtgcttttatccgcaatgccagtgggtctcaaagtgtggtccccagtccagaagcatcgccatcactcaggactagctaaaaatgcagattcttggctctatcccacatctatagaatcagcaactctgggagaggccctaggcatctgtactttaatcagtcctgctggtgattctgatgcagcccaagtatgagaaccattgctctaaggtgtggttctgatgcctcatcctgctggctgctctccagttttcaatatcttttttagaagcttaagttcaaggctgtgcacaatattctaggtatagtgtaactcacacagcacaatgggaatattattactgcctttgtcttgcatacaaattatattaagaaatccaaagtttacattatggctatcttttcccctcagccattcactgttggctcataacgaatttctagtcagttaatttctaggtctttttttccccgctcacaggaactgttgttaagccctgttgctccagtcctaaacttggcattaaaaaacaaacaaaaaaaaaaaccctcatcccagaacttcacatttattcttattaaaatccatttagttgttttggttcatggctctggctttcaaaaagtatatttctggacctcctacatgtttattattgttttaaaaatctatgctcatttaaaaaatctggaaaataaagcacaacagtagaaagacaaaaaaaagttctagttccatcatctaaacataactgctgctaacattttgatgtatcactttgacttttttcccatacataggctttgaaaggcattcttgaacaatgatgtttataaaaatttgagttcttttttctcttaacatttattataagcatttcttgtattattgcatattctttatgcaagaatattcactgttggctgggcacagtggcccacacttgtaatcccagcactttgggaggccgaggcgggtggatcgctagaggtcaggagtttgagaccagcctggccaacatggtgaaaccctgtctctactaaaaatacaaaaaattagccgggtgtggtggcaggcgcctgtaatcccagctacttgggaggctgaagcaggagaatcgcttgaacccggaaggcggaggttgcagtgagccaagattacgccgctgcactccagcctgggcgacagagtgagattctatctctcacacacacaaaaagaatattcactactatgacatattcttctagtggtggcacaggaggtactacttaaacatttctctatagttgcatgtttaggttgtgctgttatagttattactatgatacacatcttttgcataatgccttctccctaaatgtaggactaattccttagaatggcatctcagacaacctttgaaaaggtcaactctttccttcagtatatcaactactgtttctatgtcgttcataacttgataagtttgttttttagttttattattttggggttattatgaatggacatgctcaaaaaaagggaattggaatcagccaatttgttcatcctttggcaatgcccttccagatttatctattgaacaaaaatattcagggagaaacttctaagtggtgagtcttttgttaggtgccagtcaattcactaactaatagatttttggtctagttgttctactttggacaaactccatggaactatgatttaaattctcccttttgcctgcaaggagaccttgagatatttagcaatgcgttgatatcatccagttatactgtatttagggcattctttaatttaccaatgtattgttctgtttaaaatgtggaaacctgaggaaatgaacaaagcttcactgggttctcatttttctgaagttccatgttacctaagtgcagattatatcattctgtgaaaacagccagctgttcaggcaaccaaatcagaaatctcagtctttcctcttagccaacttgtaagcacaaatcgtgttgcttctttctgccagctctcaaatttataccatttctgttttagttattcccctcccttagcttctcatccttaaacattttttttaattgaggtaaaattcacctaacataaaactaaccattttaaagtgaacaattctcaattagatagaagaaataagctctcatgctcaatagcagattatagtgactacagttagcaacagtatattgtatattccaaagcggctagaagaaaggacttgaaatgttaccaacacatagaaataatgaatattcacagtgatgggcactccaaataccctgacttgatcattacacattctatgcaggtaaaaactactcacatgtacccataaatatgtacaaatattatgcatcaataaaagaaaagaaatgaagtgagcaattcagtggcacttagaacattcacagtgttgtgtgatcaccacctctatccagttccaaaacatttttgtaactcccaaaggacactttgtacccattaagcagtcactctccattccccactcccccagctcctgacaactaccaatctgctttttgtttctatggattcatgtattttggatatttcctgtgaatgagatcacgcaccaatgcgatttttgtgactggcttctttcacttagccttatgttttcgagactcatccactttgtagcatgtatcttctcattctgtttaattggcgtccccattgatagtcttggaaaaggaatagcaaaataaacccctgtagcatttctgatagtgagatctttcctgtcttctctgaactttttgcaatagcatcgtagtgtttattcatagctgaaatactatcccccagctatatattactgaattgaagcaactcctgtagggaaagaagtatgtctgactactttatttttgtattttcagaacctaatgtggatctgacactccattctttgaccactgggcagaacttagtaagaaccatggctttaccaaacactagctatgggacctcaggcaagatgggcagttttgggggtctcagtttcctcactcatgaaatggggacaaatacttttgtccctatttttactgagtggaacaattaatatatgtgcagtggctagcacagagtaagtgctcagtattagtaagatgacatgttcatttttttttcccaagtttcctctaactgcctccctcactaaataacatgctccattatagtgtcttaaaattgggaatgaaaaagtgatgccagttacataattacattgttttctttggggcagaggtacaaaatagaattttattaaactttgcctctaatatttaaaaatatttttatggaaatttaaaaatgtacgcaaaaatgtacataactaatctccgtatacttatcacccagactcaacagttagtaatattttatcatgctgatttcatctactcccctacttgtttttatgcttgagaattttaaagctaattccatctatgaaatcattttactatgattccatctctgacaccattttactataaatatttcattatgtatctccaacatataaggaattttaaaaacctaactataataccattaacatacttgacaatattaacattaattccttattagtatcctgtctgtgtgcagtttcctataattatctcaaaattgtttgctttcttttttttgaaaaaaaaaaaatggttgatttgaatcagtatccagatgaggtctgcatattgcagtcaataggtacatcttttaaagctttttaaattttaagagtaccgcctctccatccatgaaatttatttatgaaataaattgagtcatttgtctggtagaatttttaacaatcttgttttgctagttatttcttaatgttgtcttttaacatgttgttctgtctcttacattttctgtaattggttctatctagaggtttgattagattcaggttcaattttctttggataagaagacttcataggcagtgctgtgagcttcctgttgcatctatcaagaggctcacaatgccacgttgtcccacttgcaaagcgaagggcgatccgtgtgttcaggtgttgtcagcctgatcctttcatttgaactttcttaccattcctcatgcagcagtcctgtttcttggctgtacattagaatcacctgggaagctttttaaaaatcctgaggctcaggccacaccccatatgaagatcagactctctgggagtgggacacaggcattttctaaagttacccaggaggggcccggcgcagaggcttacgcctgtaaacgcatcactttgggaggccgaggtgggtagatcacttgaggtcaggagtttgagaccagaccagcctggccgacatggtgaaaccccatctttactaaaagtacaaaaattagccaggcatggtgtcatgcacgtgtaatcccagctacttgggaggctaagacaggagaattgctcgaatccaggaggtggaggttgcagtgagccaagatcatgccactgcactccagcctgggtgatagagcaagactctgtctcaaaaaaaaaaaaaaaaagttacccaggagatacaaatgtgcagccaggcttgaaaccactgacttaattgtttcagtggccattgataatatttcattgattcgtgattccattcggtgttgcaatgtttgattttcaaattctatcattctttttgcatttattagctaggctgtttttataaaaaaggattttccctcatcaaccacttgattactctgacatatagtttatacaggaaagacagcataaatggctatctttctcttgattaattttcacaagttggtgccctaagcacttccagaggtgccaaaatagttttctttttagtatcaccaacttagggaatcttatgtatttgatgtgtttaaatttgttatgatcatcattcactgaagctcagattgtcccatcttggccaatgtggggctcttcctttagtgaattttgacatgaccctagttgtttttgaaagcatctttgcctcctggcacaagatattctctttaatgtttaacctctatttaatcataagctgttttgaacaatttgtaaatcagtgcctaaattagttctcccaccaatgaacagtatattgatttttttctgatggggaaagggtagcaccttactaacttgaaatacagcattttattaatgagcaaatttgcagaaatatctgttagagactgatgtaaattatcttttgtaaggggcagtagcttatatcaatagaaacacacgtaatatgtactccatggtttttgaaaacctctgcagtgttgcattttcagtgttgatcatcaagaatacaaatatataaccatgtcatacattttaaaaacaaataatgctagtgttgaggaatataactaatttcaaatttgtggaacagtgggactatattaaaagatgagtctgggtgtggtggctcacatctgtaatctcagcactttaggaggctgaggcaggcggatcacttgaggccagaagtttgagaccagcctggccaacgtggcgaaatcccatctctactaaaaatacaaaaattagctggacgtgttggcacgcacctgtaatcccagctatttgggaggctgaggcaggagaatcgcttgaacccaggaggcagaggttgcagtgagccaagattgtgccactgcactccagcctgggcaagagagtgagactctgtctccaaaaaataaataaataaaataaaattaattaattaattaattaaaaaaataaaagacgaaacttggaatagtaaatacttaaaaattctaacaatatcaacaggtagtgatagtttaaacatgtactgtaaaagtgtttggtttttaagggtatgtaagagactggttgtctgtgggactttgaaagcagttgggaaatgccacaatagcctcagtataaaattctagagacccaaagcggagagagatgcctcttaagaattatggaggatatttattacttttattcatgggatgggtggtggtgatttaatgcctgtctcttgtttcttttgtttttttttgttatccaaatccaaatccaaattatatgaggaattcacttaaaaatatacgtttagtttggtttaataaaaataatcagttttgatgtattgacttttaatttcatgggggaaagagtccattaggaatgttcaggctttctgtgtatattttgtgttgctcattctctttggcccaagatgaaactaatagccacaatgtgtctgctttggtgctgtctctagggttgtgtctgctgctgtcagctgcacccttgttatctggctgctggtcctgctcagtcagttgtacaggaatgtcatttccattaataaccccagggccggacaggcagatagtggaaaatgggtgaagagagagaaattgtatttaacccagtgttctgagttgtcatttttgagaccctagcatagctgggtaaaggcaagcagagggcatgacagcaaatctatttctggcagaatctcatatacaaactggagaaacagcctgataccaagagaagaaagggtgaaatatactgggaaaagagggaaagatttggggttggaaaagtcagaggaaacaatgttaggaagaaataacatgatcaagtattctgatagaggtgctgacaactttgcaaaataaatttaattttgattgtaaatgccatcatttgtggtggttcaaatgaacaaaattcctttttaaaaaatgaaatttatgtaaggattgctcatagaagattttggagttttgtgctatgtttttttttttttggttctggatcagtgaaaggcccgaggaacagagtaggttttatttttttttccatctaggtagaatgactcagttactgtagttgtctgtgttttggttatttattgctgcataacaaattaccccaaaacttgctggcttaaaacaagtattttattatttcctatgattctgtgggttggctgggctcagctgggtggctcctctgctggtttcacctggagtcccttaggcagttgcagtcagatggtggctgtggctggacgtccaaggtggcttcttcacacatgtgtctggcacctcagtgttcctcatgtggctttctcaacagggtgctgtggtactcctacagggtagctaagagtgccaagaagagaaagcagaagctgccggtcctcttaatgtctgttctcagaagtctcagaatataattgacaaataataattgtatatatatttttggggtacagtgtgatgttttgatgtatgtatacattatagaaagattcaatcaaactacttaacatatccatcacttcacaaacttatttttttggtaagaacattaaaaatctattattttagcaattttgaaatatataataaattattattaactgtggccaccatgcagtacaattggttactaaaacttattcttccagtctaattgaaattttgtgccctttaatcaaaatctcccctttccctatctctccccctccctccagcctttggtaactactttctactctctgtttctatgagaacaactttttaagattccacatataagtgagattatacagtatttttctttctgtgttttgcttacttagcattttttttctatttttctgtttggttgattaggctatttttcattattgactgaattatttttttctgtttagctcaagaccattgtatacatcgactcacagaagtatttgagtaagcctaatcattgttgaactgtgatggggaaaggattcagccttgggacacgtgacctttgtgtacaggtgtaagaaattcctactaggttttagggcccagaactggactaggccatgagggacccaacccatcctagtaggcaaatcattttccagttttatatttgagttcattagtaaataagtttactttccattatagacaccccctccactgacttatggggtcctgtacgccataaccaaagactcagtgttggaaaggtgatgctccactctgtgtctttgtttagctaaggtgaaggggacaggtctgccaccctggtatattctggtattctctcattggcagtcttagtgaaggctcatgagagcttcctcacagaggtttgtaaggattagaactgagtggaatagacctgttccagggcagagtgaagccgaggacaacagtgagattgtgtccttcagggccacagaccagaacctttactcaactctgatgttaagctataaagctagtttacaagtttatggaacaattcagcttgttcttccaggctcttgaaaatgaaggttaaggctgggcccgtggctcatgcctgtaatcctgtaatcccagcactttgggaggccaaggcgggtggatcacttgaggtcaggagttcgagaccagcctggccaacatggcaaaaccctgtctctactaaaaatacaaaaattagccaggcgtggtggtgcctgcctgtaattccagctactcgggaggctgaggcaggagaatcgcttgaacctgggaggcggaggttgcagtgagccgagatcatgccattgcactccagcctgggcgacaagagcgagactccgtctcaaaaaagaaaatgaaggttaagttttggcaaagtgatttgtatagatctgtaatacatcatgttctaatgaggtccaatgagttctaagtaatttctgatttccattaaaaatgattcatgaaaaaataagaatctcatcagagagagagagagaccacttttgaaatgaggaaaaatgacagaatagaaaaggagaaagtctcttttctctcttcttccccaagcccccctcatcactggttacttatttgagcatcctttatcagcatctaatgagaatgagaacatagtgggatgccatgtgaccttttgagtaggaattggaagctcttatgaagtttccagcctgatgtcacttcagatccaggtcattaatatttaaaaaaataaaaaaaataaaaactcttaggtgattcgaatgagcagccaagtttgagaagcagagccctactggagcaatgcttctgcaacttgaatgtacatgcaaatctcctggggacttggttaaaaatgcagattcttaataagtttggaggggagcctgagagtctgcatttctaacaagctcccaatggaggccgatgctgctggacaatggcctatggaccatactttgagaatatagagcagggggcagcaaacttttcacatatgaaggcctgagagtaaatatattgggctttgcaggtcatgtggtctctgttgcagcaacccaaatatacctgtagtacagagcagcaataggcaataggcaaacaaatgggtgtggctgcgtgccaataaaactttatttacaacaccaggcagtatcctgaatttgtcttacaggccgtgagccaataaaactttatttataacaccaggcagtatcctgaatttattttacaggctgtgacttgccaacttggtctagagctttccctgtctcaagtttttgagccgtatcttgcttcttccctgttttgttgggctgaatcttaggtaagaattaaatggttttgaaagaggttactcaatggctttgttgaactgatgaataattgatgatgacatttaggctctgtttacaaacagccccaattgtcccttggttgtggctcattgctttgccttgaatataggtggcctttctgatttctctccctagactgcctcttcagcaatggatcgaaacagagctagggtttattctaaaatgtggcccacgggcatctcagaataaataaccaggtctgaactgtagaggcagagggtggcttcaggtcacttttccttgacctgcattttacaactcatctctggtgttttgtctaaggcgacagaggctggtattttggctatctgagaggtagagagcagagaggttcctggacatgtacattttgtgttgagataggtcatgccccagatatggctattaatggtagcagagagttaaatgttgctgataatatattctaataagtagataatacagaaccaagttgtcagagttttggggggacccaaatttggaaccaaggactcaaagctcagaagggttccatcttgtgggcttcaggagtaaggtgcaagattcctggtctgctgctcatggtaaatttcctgcatttcaaaccccaaagtcagttaggcctaagcttcaggaaagttttcagtttaattggttcaaaactgaaacagactctcatctatctttatgacagtgctaggattcctaagggagaggtgttactcctcttctgaaatgggaggatgtgggccaggaatccttgggccagggatgcttatggcagactccatttctcagcatggttttggctgggaatttcctctatgagattgacccttctctccccgaggtgccattttctggaataccaccttctctctgctggtaaaatctaatttaccttagtgccttgactggtctgcaaaataaatgttctgacgtttcctgacaggagagcctgtcctctctgctttctgcttctttatcattcttgtactttcttgccttgccttttccattttgatcttctctcttggccaagtcttgtcttccgggggctctcagtcaaagtttagtcccaccgatgtccagaacagaaagctcagtggtattatttttagagagggagggagaacctcttaaaagcatacttaaaattctatctgtgtgtgtcttttcatccttacatctgagaatattatttgtcttggcatgttgaatatggttactaatgcagatgtggtctgtgccttacatgttattcagtttgatttataaaaaatgaataattatataatagaatatttaatcactcagaagataatatatgttgggaaaacatgaaatttgaagtcagattaaggctaaattaatctaggtgagaagttggttttggccctcattgcctgtgtagacttggggtgagttgcgctcattttctgagtcttagcttatgagctgtgaaatggggatgatctgtacctaccttgtacagttagggtaggatttggatctgatgatgaagtaaagtacttagcacagtacctggtttatagtaagggtttaatggagagcattacttttgttatttaaaaaattatgtctattgtttctgtttctgtttagctctgagatctcctcctctttgaaaatgtcctttccacaaggcccttcccttcccatccattccatctgaccctctaccttcttctgttgttttttctcttacatcgcattctctccctatgaccaactatgaactcctgaaggaaagaaatccagtttattaaactgtgtgtcttcactccgtctaaacacaacaacatggacaaatttcacagatgtgttgttgagtggaagaagccagatacaaaagagtacacactttttttgaagttcaagaacaggaaaaagtaatttatggagacagagatcaggatagcggttcttttgaaggtggaagggttattcactggggaggtacccaggggagtcttcaggatgctataaatgttttaaatcttgtctcaggcctactaacacagatgtgtgtatgttttaaaaaatatttgattggtatacttagtatttgtgcactttgtacgatatagtgcagtaaaaattttaaaagatgtttcccagtatgcagggcttatttgccttttagtgatcattcagtaaaaggttgaatatttaatggatgtcatgatgaagtaaatgatcaacttttttttttttttttgagacagggtcttgctctgtcacctaggctggagtgcagtggcaccatcatagctcactgcagcctcaatctcctgggctcaagagatagtcctgcctcagcttcctgagtaattgggactataggcatgcaccacaatgccaaactaatttatttttttgtaaagatggtgtctccctatgttgcccaggctggtctcgaactcctgggctcaagcccccaccttggcctcccaaaatgctgagattacagctgtgagccaccgtacctggccctaagtggttaatcttaatcaccatgtgaccaagaccaaattttaaggaagatgtagcatacattttggaaaacatggtagacataattcataatttatagccagaattcacgctgttgttcatggcgctacttggatcttcacatagctgtttcagaaaatatagtaaatgcgaacggcaggacttgcaatttcagacagtttgtgcagttggcaggacagagaacacagagtggggatacggtcctgtcagattggtggaaaacctcatttttaattgattgtctattgcatctatgcccctcttttcccaccctccctttgtccttttatcaattctacttggaaataaaatctgcaactctaatagatgctactgacactcgtgcagcaattctaccagatggcattcgaatctcgggtgttctatgaaaaatgaaaagaccaaacacatgcacaaataaatgaaggttgaattaatctttataattaaacggaatattaccctgctatgactgatttttgctttcaaactggattgcgtgctaatttttcagtgaactgtaattgtattaacatggcttttttgatgcctgaaagtacttaaaaatagattttgcgaagttactgagagaaaagttattagaacttttaatctaaacatctctaagatcctgaggtatatttatatcacgacttacagctgcaaagcattttccaatagttttttattctttgtcccttatcatcctgggatttaggtggcactggccagaaattgggttgaattgcaagtacctgaggcacgttagaaaattgatgtcctactgtgtacccacaaaaattaaaaataaaaattagaaaacaaatatgtacaactgctatgtacccacaaaaattaaaaattaaaaaaatgagtgggagggaaggtggtagagttttctacataaagtgcacctactagcttagtagtggtgactattagtgaaatccctaaggattattgaagcagaggatgagtcccctacttatgaactgataacacagtgttgggggttctcagaagtgggtccagaagccttggtaccatggcaagtaccatgatctacagcagagagtatctcaaatttcagcaggcatgagactcccctatagtagtggttttcaacccagagtgatgttacacacctggagacatttggcaatgtctggagatatttttgatcacaactggggggacagagggtgttactggcatttagtgggtagcagccaggaatgctgctaaatatcctacaatccacagaacagtccccagagataagaatgattctttcccaaatgtcaatagtgccaaggttgagaaaccctgccttatggtaaggctcattataatgcagattcctgggtcccagttcagaagcattctaactcaagagatgtagcattgtcccacaaatttgtgttttcaacaagctcccacgtgacacagatgctgccagtccaaagacaaagctttgggaagccctaagctagacgatgccagtgtcaaaggaacaagccatatatgtgggcactggccctatgacattcccttcttttagaaaaatgatatgaaaattcccacttgcattgattgattgattgagacggggtctcgctccgttgcccaggctcgagtgcagtggcatgatatcggctcactgcaacctccgcctcccgcatttaagcaattcgcctgcctcagcctcccacgtagctgggattacaggcacacgccaccatgcctagctaatttttgtatttttagtagagacgaggtttcaccatattggtcgggctagtttcaaacttctgaccgcaggcaatccacccgcctcgacctcccaaagtgctgggattacaggcgtgagccatcgtgcccagcccacacttgtctaatttaataattcaccaaagttatctcatttgatctctccccaccagtttatgagggaggtacttcacaaggtttttaggtggtaaagaattgttcatataagagctaaccttaaaggaaagaatgacaacaattcccacttaaactgttgatgagacaaggggatatgtttatctaggttaatctccaacttgcctcctgtttaaataagtaatttaacaactggaggaggattaagtagctgattaaatttctctgagaaacgttaggtgttagggccttggtatttattgcaggtgtgtttctaagccctttcaaccttgatatttgaaaatgtttttaaataatttgtaagtattttttcccattccccaaaaaatgcattgatttatttcatagtatttattcccattttggttaatatttctatactggctgtgttttaaatgtagatatttacctcaacaaaatatgaatattacagctaattatagaattatttaaatagttattatttaattatatatttctatcttgatgaaactttccgaaaagattaacctttgtgccttatttttcccttgctatctttactattggttttgaaaaatggggaaacctcttgtgtagaagaggggttggcaaaccatttctgtaaagagacaaatggtaaacatcttaggcattgtgtgggctatatggcttctgttgcaactactcaaactccactgctgtagcatgaaagtggcagtaaacaatacttaaatgaacgtggctgtcgtcagagagaaaaaagcaacttttcctttaccactttaggtttaatgtcagggcctgtgaattaaactataaaagatggattaacaagagaaaagcaaagtttattcactaacctgcatgagagcttacagaaaacacagcccagagaaacagaattggggggttacatattgtcttaagaaggggtagggttaggattttaagggacaataaatggtgggaaatgactgagaaatatatgaggggacctaacagaaagtcaggcttgctttagtaaggtctgtttatgtaagttctcatcctggcgccaactttttatccccggtgagaggagttattttcccccggtgcaagaagtgtctcttaaaagggggatttacgacagttgaattcttttggaagtctctgcttgtaggccgataagggaagcatggagaaagcctctttctgcttgtcttgattctcagataccttcagctcaaaatagtcctttgctacagtagcatattccggaccaataaaactttctttacaaaaaaacatgtggtaggctggcttgggctgtagtttgctgacctctgatacagagccctgtgagtgagacagagacaaacataatttattttggctcatataaaagcctaagtgtgatataggattgttcccactcttgggctgttatcattttggttatgtctggataaatgggcttagctaattgaggcttagggtattcatttgactaggtctagcagctgttctatttgcaaactttgtgagcagtttaaccacatataatcgaaaccaataaaaacattgatttaaaaatttatgatttggccactcttctgcccagtttcttttcatctttttttttttaatttaatttttatcatttgggacagggtctcactctgttgcccaggctggagtgcagtggcacaatcttggctcactgcaacctctgcctcccaagttcaagtgatccttctgcctcggcctcccaggtagctgggatttcaggtgcaagccaccacgcccagctaatttttgtatttttagtagagacagggttttaccatgttggccaggctggtctggaactcctgacctcaagtgatacacctgcctgagcctcccaaagtgctggaataacaggtgtgagccacggtgcccagctcctgcccagttttaaaggaaataaatgagccgggtgtggtggctcacacctgccatcccagcactttgagaggcagaggtgagcggattgcttgagtccaggagtttgagacaagcctggacaacacggtgaaaccctgtctatattaaacaaacaaacaaataagggaaataaatgagagttgcctctatttttaaggtaatattgctaccactctaaggacgatgggtgtgttgttttattaattaatcataaggtggctttggcttctaaaatctattgctactacctgctccatctgtttaccaagaaaactcaaatattactttctttctttaactctgttcagtacagggctcacccaagtaagaggagcatcacaaagacaccagggaaatgtttagtgccagtatggcaaaattaagatttacttctgccagagtagtttccttttgcagacagaagaaactgcccacctccaaaatatattgagttggtgttttaggagagagcatggatggtgcttgtttataatttggaacatgccttcctagaatgttgtctatcttagagagtaatgagggttttctgctatactggggcattattcacatggggttgagggtggatgacctgaaatctgatctttcctgtcttttacttcttgtacaattagaactgtgatttgcacttagagagccttctgattcatggaagtgcttatctatcttctacccctgtatgatgcatctgcttgtggaccgcacccaaaagcaatttgcagaattaaagtttttgaagactcataataaatcagttcaattttatcaagagaataaaatttgattcatcagataactgcattgttattatttgtgggatcctgatagacccagaggatattaaagcctgttcccctgactaattttcatcaataccattagctccgcttagggtaatatcttcagctaaggcatctatactagtcaatcatttgtttggcattatggaaactgccattgttttgaatgatagtgtaattcatgtacagtctcctgaacttctgggtgcttaaagctcagaattttgattgatgtttaatagttattacagaactcatcagagaaaatgaggccttggcatgattgagcctgactgaagctttcaaagccactgcaagcttaggaaagttgccctataaattttttatgaaagggcagtgatcagttgttccatttttttcttaagttggttaaattaataaaaaagaaaaaatatgctgagacttaaccacgtatactaaacatacagctatttaattaagtgattaaagtggtctctttgatgtgatacatgcaagacatttgagaatttatctgactctcctaaatagccaagtcagtggggattaaaataaatgagctttctgtcttcctttctgtagatcagcttaatagtaagtggctttgaaaattcaggagtaaagcagtcaacctagccaatctttaaatcagttcagtcacatatataaaaagtagatgccatttcagagctcacagctaaataaagcagaattatgcctgattctgttcttcccaccagcattatcaagttgtagtatacagtattgaaaattctgggaaggtgggggtgatttgagagtttaaatcatgttgtatattaggttttcaatgttcctcatttttctgagttcatttgtgatagctgttgtttctctcttcaaataataatctttacaaactctctgttgtctccatggaaattaattgtgatttttaaagctctagcactaagactttagggcagggagtcaactcccaagcaactgagatctgtcgcatgtaaatggtagtaatagcaaagagcaaagcaaaaacaaataaaaatcttgatagctaagccgtgcgtgcacgtgcacacacatgcacacagatgatgctgttgagcatggatcagtttggaagcattgttaagcacttactgtgtactagcccctgtgtcatgaattgaggcaactcagcgaataacctagctttatttaattatctgtgttggcttagtaagttatggcccttgggccatatttggcattctgcctgtttttgtgtgaaccacaagttatgaatggatttcacattttttaaatagttttaaaaaatcagcttggcacaatggctcatgcctggaaccccagtacttagggagggagatgtgggaggattgcttgagcccaggagtttgagacctgtctgggcaacgtagtgagacctcgttctccacaaaaaggaaaacaacaacaacaacaacaacaacacaaaaggacaaaaaaacacaccaagtgtaaacaaccaaaagaagaatatattatgatacatgaaagttgtatgagattcaaatttcagtgtctataaagttttattggaacagagtcacagccattcatttatgtgttgttctagcttgtttctgctttctcaggtacaatcacagagctgagtagttgtgcagaggccatatggattgcaaagcctaaaatatttactatttggcactttacagaaaaagtttggttattcctgatatgggtaaggcaaacttcataattcctttattatctgaatacttctcccaactctctattttactttattggtattagaactaaatgtatccatattctacagacgaggaacctgaggaacagagagattcagaaaattcagctattgctaataccttatgtgatgatgataacttgttatagaatggttttcctcagctttttaaataaaaatgcagttaagtaatcgataatattacgtttgtatgttctttcagcattaaggagagtcctgagccttgattttatgttcagtatgtgtattagtctgttctcatgctgctaataaagacatacctgggactgggtaatttataaagaaagaggtttagttgactcacagttccacatggctggggaggcctcacaatcatggcggaaggcaaaggaagagcaaagtcatatcttgcatagcggcaggcaagcaagagaaagcatgtgcaggctgggcacagtgtctcacgcctgtaatcccagcactttgggaggctgaggcaggtggatcacctgaggtcaggagttcgagaccagcctggccaatatggtaaaaccccatctccactaaaaatacaaaaaattagctggacatggtgtgggcacctgacatcccagctacttgggacgctgaggcaggagaatcacttgaacccaggaggtggaggttgcagtgagctgagattgtggcattgcacttcagcctgggcaacaagagtgaaactccgtctcaaaaaaaaaaaaaaaagaaaagaaaaaagaaagcaagcatgtgcagaggaactccccttcataaaaccatcagatctcctgagacttactcactatcaagagaacagcacaggaaagacccaccctcatgaatcaattacctcccactgggtctctcccatgacgtgggaattatgggagctacaatttgagatttgggtggggatacagccaaaacatatcagtaagtatttgctgattgattgaaatagcttacataaaatatatagttttgtttgccaccaagaattaattgcattggaagctgagtgtggtggctcacacctgtaatcccagcactttgggaggctgaggtggacatatcatttgaggtcaggagttcgagaccagcctggccaacatgatgaaactccgtctctactaaaaaatacaaaaattagccgggaatggtggtgcatgcctgtaatcccagctactcggtgggaggctgaagcagaagatgcttgaacccgagaggtggaggttgcagtgggctgagattgtgccactacactccaacctggttgacagagcgaggctccacctcaaaaaaaaaaattaattgcaatggattttatatcttgcttaattttccagaatgttttatatgttctcacaaaatatctcattttctccccttttttctctcctgtggtaagatcagttaatattgaaatataccttaatgttagctgggcatggtggcacacgcctgtgatcccagctacttggtaggctgaggcacaagaattacttgaacctgggacatggaggttgcaatgagccgagatcgtgctactgcactccagcctggatgacaccgtgagactgtctcaagacaacaacaacaaaacccagggaaacgtaccttggtgtgaacagcactgaatgatgtttatgattgtatgttaatcctcttatatttaaaggttaaatgtaaaatatagccttttatattttctgatactcttgatgacattgatcatagtgggtttatcaaattattcattatatgaattaatatttattgagtattggtcacttgctatgttacctgtggtaacatggtgattaggtggaataggctattggtttaatttgaatagtattagaagattctctcagctacaaaacctctcatttaattgtatttattcctttggctaataaactactcttttaaataaaagtatttctccagagtaaatatattagattgctattagtgacttacattctattataaactagtttgaggccccagtggcagctagtggattagcaaccttgaagaattaataattttgatggatgagaagggaagggggagatatctttggagcacagagtattgctaaggaaaggccaactagggtacgatggtattgcaagtggtatgaacacataggacctgctaggtgttgaaaggaacagataagagaaagagaaagaggaggaaggcagaaaccaagatggcaagtgctaaaagcaacctgtatctttgatcttttctagggttagatttggtagtgtttcttgtgtctgttttcagaggtgtgccaatagtggctctcaaaagagtcctccaacttttggggggctgcaaatagcctggattcttttgactcatatgcagagtctggctttgctaggaaaatctcctaccatgctccaagaagcttgtacatttgtcttccattgataagagggttgcctcaatagcttttctccctaagcatttcttttctcgatatttttcctctcaccacaagtgtggccttctgaaactggacctatgactaaaagagtgacattatttctcaggggtttcaggtgtttggttaggggtataagatgacctggactcttctggaagacctccaaacactacacatcacagttactccaaatccttggaaaaagtcacgtttctactttcttggtgtagtctacaactaacatttgctcatcatgtactctggaccaagggaaaaaagtgttttacatgcaatgtcatcctgaactcttgcagacaatgctatgaaataggtactaatttttagtaatttttttctcaacatctgatgtaaaggagagtgtgttaggattacattagctaatggaaaacatgacacataatgcctcaaacaaataagggctttattttctgtatgtcatgaagggaaaagagggaggcagtccaggtctaatatgctggccttcgaatgccatcagcttttcatcccaccatcttcagcatgtagattttttcctcatatgtgttgccttgtgattactagatggctgctcggcttctggcattgcatcagcattccagaaaggaagaagaggaaaggctaaagcagtagttctcagctggaggtgattttgccaccaggggcacatttggcaatatatggagatatttttggttgtcacaacttgcggaggggggcatgggttgctcctggtatctaatttgtagaagccaaagatgctgctaaacatcctacaatttataggacaaaccccagagcaagaattatctggcccaaagtgttgagaaaccctggactcgaggcagaaagcatatgctgatgaatctgtccccttttaaaatggatcattggaagtgcaacaagaagtttttcttaaatgtcattggcccgaatctcatcctgtagctgactccagttggaaaggaagctgggcaacacagctattttgttgttgttgttgttgttgttgttgagtccattgtcatcctgagcagaattggagtcctgacagtaagagaagaaagggagaatagttattaggtagacagtaggcggtgtttatttcaaaaagttaagtactctgcctaaggtcacagaggtagtgaagatcagcagctgcgtaaacctcctctattgaggaacggatgtccagctgtcaagtgcagcttctctctacatgtctgtatgaataaagcatgaaaatgcatgcactgggtatggaaagccctggagtttttgatcagccacaaacagcctaggaaatatttcttgcaggatataatatgcaatctgttaaatatttatatcactgctctctcagcatttacagtgggacttgcctttcctttttgtccatgtaaccaatagggtaattaatctcagacctgactcactaatactttgcccttcaagccatcaaactattggtgcttcacttctcccattttgaaaaattaaaaagtgatgtgattactatttgccttacttagggttcattcaggaaaccagacactcttctaagtatatcaaccagcaagacatttaatacagggaattggaggcttaggtaacctttcagagggctggggagtgaagggcagagtctgtcaatgatctctgctgcttgtacaccaaagaggtctttctcaggagaatgcctggaagttgctggaaaagggctgtatctgctgtctgcagatgcccacatatctgtataaggctaccaacagcaaatgaatggcatctcctcttctacctttggaattgcctatgagtgcttctcattggcagtctaacctggagccatgggatattgcaagatgtatttctgaagcttctcagggaaaaatgtagaatggggtggggtaggatgaggaggaattgacaacgaagtctgtggcagaaaaaaacatttgaatctgaatagaggaatacatatatagcatattttaggaagaagaacactctcttcagatgttggcaatgttgctactagtattattaccttattctaggtatgtatctttgggaggtaaatagggattctttgtatgtgttctgattatcttcaagtcatgatgatgctcaataaataataaaaaaggattcaataacctgcatagatggtgcagaaggtaatatattctgtgaggctctgtagtgcagtgggggtcccagagatgaggtttaaaaaacaatgcataattcaccagcatgctctggaaagaccagtcttcagaaaacaattgtggatgactcagcttgtccgttcgttcgttcttttcttttcttcttttcttttctctctctctctttttctcactttctctccaaaactatctggaattctttacttgctatagttatgcatatgacttatagcgagctgataaaatatagtgcaaaattaaatacaatgccggaaataatagaataatctcagaatgaggtaacctatagatgtatgacatagtttggtgttgggggtagagttgtaacctctagttatctgctatctgggtcacatcaagcttttagtgtgtgtaactcacagagttttgaaggtgtaatttgatctgtgctatacttgagtctgtgaaacagcaaaacccattatgactatgtcctacagcccttgtaaaatcctaagtcttgagcttcaggattctgctgatatttaatatctgaattatttcaaggaaggtaaggaaagtgtactatcttactatgtttatttcttgagtgaggaaaattgaaagggactaaaggaaagaactcgttgccaagagcagtgtccagaggtcactggttttgctttgtggctttgctggaataaaaccaacgtgtttggggttgcctaggtcttatgttgggtcatctggaggcagatctggagatgagaattcctgtgtaagtgattcattaaacaaatactcccaagagaaatcagtaagggaatgggagaagcaagacagggagggatgagagtccaatttcaggagacatctcagaactagtctgatcctgcagggaactttggaagtacaaattatacctcagagtttgtcctgaattgaggcaagggggctgggctttcatattgccgcttagggctgcttgggtggaggcagaggcggaggcggaggtgcaggtgcaggaaaagtgggtagaaggcaaataaacccccaggaactagctatttttgattgcaggcaaggagctctagtagttcctagggcaggccttcagaaagtctcaggtgttggccattagaaaagaaaaaacatagatgctggagggatgtacagaagttataaaagggatcccagggaatctggtcagagccctgacagtgtacttgtaagcttctcttttgcttttatgaaacccagaatctggagaagggagagagaaattttcacatggaactgtaaagtttctctaaagcaagggttgacgaactttttctagaaagggccagataaaatatttgaggctttgtgggccacagggtgtctgacccaattattcaactctacaactgtactgcagaagcagccatagttgacaggtaaacaaatgagtgtggctatgttccaataaaactttatttataaaaacaggggtagggtggctggatttggcccagggaccatattttgccaatcgctgctcttgaggttctttatatgtgcctaagtttgtttttcctttatttattccctatctgttataaaacacagaggataattagtacctttgtctatctaaatgatggttatgacattatgatgtatcttaaattattctagatcactgcctccaatctttctggcatcctggccatctttcacaatgttgcaaagataatcttcctgaagcatgactcatctccttttattcccatgctaaacatatttagctctctcttagctgtaaaataaaatataggcttgttaacatggcattcaggaatccctgtgatctgaccccaggccaattttcctgcattattttctgttctccatcctcatgtacttatagtccagctacattaaattactcgccctctctccaatatgccatatcgtgtgtgtttgctatctccttgtagtttttttcatttttatgtatttaaactgactatatactgtcaaaattttatatatatatatatgatgtacaacatgatgttttgatacatgtatacattagaaaatgggtaaattaacatatccatcacctcatatatttatcatttttgtggtaagaacatttaaaatctactcccttagccattttctagtgtacaatacattgatattaactatagtcactatgttgtacaatacatctcctaaacttattcctcttatctaactgaaattttgtatcttttgaccaactccctaaccccattcccccacccctggtaaccaccatcctactgtactctgttatgagtttgactgctttaaatttcgcatgaatgagatcatgcagtatttgccttttggtgcctggcttatttcacttagcatgaagtcctacagattcatccacgttgtcacaaatgacaggattttcttcttttttaaagctgaatagtattccattgtgtatatatactacattttatattccattgtgtacatatactacatttttaatccattcctctgttaatagacatttaggttaattccatatcttggctattttgaatagtgcttcaatgaacatggaggcactctctttagcgtactgatttcatttcctttggatatatccccagaagtaggattactgctttgtatggtagttacatttttaatttttagaggaacctccatagtgtttttcatagtgactgtaccaaattatattgccaccaacagtgctcaagagttcccttttctccacacccttaccaacacttgttatctcttgtcttgttgatagtcgccattctaactggtgataggtaatatctcattgtgtttttaatttttatttccctgatgagtaatgatgtggatcattaaaaaaatctgttgacaatttgcatgtcttcttttgagaaatgtattttcacgttattttccctttttaattttttaatttctttttttttttttttttggagacagggtcttgttctgtcacccaggctggagtgcagtagtgtgatcatagttcactgcagcctctacctcccaggctcaagtgatcctcctgcctcaacctcccaagtaattggaactataggcaggtgccaccatgcccggctttttttaaaatttatttttgtagagacagggtcccgctgtgttgcccaggctggtcttgaattcctggcctcaagcaatcctcctgcctcagcctcccaaagctctgggattacaggcatgaacaactgtgcccgacctcctttccccattttttaaccaggtgatttgctttcttgatattgagttgagttttaaatatattttggatattaaccctttatcagatgtatggtttgcacatatttttgcctctgtctttgcccctgtttcttctcctggaatgttcttctagctctacattttgaaatcctaaccattctcttaagactcgattcagtcaccttctccattaagcattttctccatgcagaaacagtctctcctctggactttgataacaatattgtctatttctattaaattttttattttgtttacattgtactagacagttatttgctacattcactgcatttttagtatactgaggtctctcaatatatatctatatatttttgcccttcacagtggcttgcatatagtagatattcagtaaatggagttttcagatgaagggcgcatttctacatcttgtgattattaatgatttaagtgctgaaactctgacattatttttctttttcctttttgtaggcgagagctgttttggcaaaagttggctatccagagtttataatgaatgatactcatgttaatgaagacctcaaagctgtaagtgctaaatttactgtacttttttttttctggcaagttttactggccttgtgcctttcaactaacccaagtcctagcaattaaaactggtgatgccagaaaacaccaacttttgattaattccttggctagatatgagcctgaatatgccaggcagatcacaagatttagggcagattcaaaataaagaagtgtcagaaacgatgcgtagctgagtgggtaccaaaaaacaaatggacttgggtttggcctaatttgatcataaaagaaagaattaagcaaattgagtatgttacaattagtgggcatgttctaatggcaaatgcatcatgtttgttgttaaatactttttatttgcttcattcgtattaaatgaatagtaataaatctgcctgctgggagttaacttcattaaactttatgagtgttttggcaaattaaatgcatatacatacgactctataatttattgtgaattggattgtgtatttgcagtaagttactgatgaaaaatggtcataattcttttttatttcaatatttttggacatgtattttccagtaggtgtattaattacaggcctttctattcacaagcactgttatttcctctcctacaaatagttctgataagtgatttttcttcctcatttaaaaaaacctgtttttactattcactagattttcttgaaaatgtagtcttttgaaattctttaagtaactatagttctgaggtatagctctttcctgaaattgtggttcaacaagtggcatatctgaaaacgatcccagctttgtagatgagcatcaaaattttacaagactattcaaaagtgagagaaagcattaattagaatcttcctccattgggctctaagatatagcctcccaaaatattgatacagttgctctggaagaaaataatgatgcctcatagcatcctaaaactcagtctatcttattatacactgttttgatgatgctgaaaatcccattattattatcgtaactaaaaatattgaagcacttgacatattcatgtacattatcttttaattccttcagtgattctgtgaaatagatgatgttcattcccattttgcagaaaaggacatagagactcaataatttaagtgagctcctcagttccacacagactttcagagccaggactgatatctgggctcaggaagctctgcctgtaatcagacaagggattcttgagggtcctttttaggcagctatgctggaggaacagaggcatcagggtggagacttggtgggggcagtgtgaccagggctgttggaagaagagcagagggaaggccatgttatcaaatggttaagagcacaggctccagtatcatgggcctgggtttgaattctgcttcttgtacttactagttatttcatcctgtgtaggttacttaacttcggttagcctccctttggttatctggctactggaaatataataaccaagtcttagtattgttgggaagattagatgagactgtataaatgtaaaagcacttggcataatactctggctcagagtatagcctacttcctataaagggtagctttgcggatcaatatggaccatttgtggtccattttcaaatcagccatataaaatattccatttcattgatccttaatagaaatagactcaagcgtgaatttctaccaattttggaaatatatctgtatcagccaggaaagcaaaaagcacagtaggtattttaaacagggaatttaatacaggaaatgggttggaaggcaagaaaagggaaaatagataaaccacaggttaaactgctgttgctactaagaagagtatcatcagggcacaaagtaccttagcaggagaacctgggtaactccatactattggtatatattctgagtcagcatgtggatgagaaggtttgagagacagtttgatgtagaggttataaatagggaccgtggagtcaaagtgcctggagtaaaacccccagtctaccatgtaccaccttgttacctagggtaggttatgtatcctctctgtgcctttcttcatctgaagaatgaaggtcataccaatccctcccatataggatttctgggaggatcaaataagttaacatatttgaagtgtttagaatgaaccctaacatacaatcagcacaatacatgtgttagctatgacatcctcaattcacacttgtggtagtgaactattttggtttgaaaaagtcctcatgaattaactcatgcactgtccaggtccctcaaattgatttaaaagggtatacagatggagcagtctcaagctttaatcgaataaggtagaacttaaggcttactcacaatatttagttgatcaagttttgttggcattctgttgctaagttcagagccccaaatttaaggacccattgaatgcaatatcttttgtgaaaagaaaccagatgccaaacaggatgccatgttggctgtgcttctttgtttctctggggcctgaactgaagacattacacaccaagatttttaatcacttctttgaagaaatggctttcatctgactcattgccaaagcagacacaattacgcccaagagttttaacagtttaaaaacctgacagtgaaaaaaattccaggtacatgaagtaaaaagacatttgtattcagaaaccgattgttttagtcaatttacacggtgctataaagaaatacccgagactggataatttatagaggaaagaggtttaattgactcacagttccacacggctggggaggcctcaggaaacctacaatcatggcggaaagtgaaggggaaacaggcaccttcttcacaaggcggcaggagggaagagtgagagttcaggaaaaaactgccacttttaaaaccatcagatctcatgagaactcactatcacaagaacagcatgggggaaactgcccccatgattcaatcacctccctcccttgacatatggggattacaagtccctcccttgacacgtggggattacaattcgagatgagatttgtgctctctcactttctctccccctcaagccccgcccttttctttttctgacagtgacttcagtccctcctccaaacctcagctctggagtggcaggcagttctcctctactctcctaagtgatggtaccatcacctcctcccttctgtgaccctagacacaggagtcgcagctgtgtactcctgtgactctcacagagccaaatcatatcactgatagagaaaatgaataaaacccaccctaaaaataggtaaaggatgatatgatagattgtaatattgtcactgagggcaatagcaaaaagactgaagtattcctggtacacaatgagactgttttcagttttaagaaacatgtagataaggactgctataggacctatgagaaatttctggtaatacgagctctgagcatgagaggctgttacaaatgaaaaacagcatgctgcatttgagacaggtggagatatgattcatcaggcacaaatgcaaaaggaaagaggagcgagattacctgatggatcagacgaaggtcaaggagaaatgttgaaaattgaagttgggctcatgtggaaataaaagcaaatgagatagaattaagaggtaaatatgcaaaggaatcagaaattttttaaggatgacaaggtaaactgaggtactcagcaaagcatttccgaacaacaatcttgtagtttttgaaaagaacaggaagaaataaaatgccctttatttgaacccccatcaacatgcaggaaagcctgttagcctaaaaaggtaggcatgagcccattttcaaatcagcctaataaagtattccatttcattgattcttaatagaaatagattcaaaagtgagtctctcccaattttggaaatatttcagtattagccaggaaagcaaaaagcacactaggtattttaaacaaggaatttaatacatgaaatatgttggaaggcaagaagagggaaaaatgagataaaccacagattagtaactttagaaagcagctgcgactcctgtgtctagggtcacagaagggaggaggtgatggtaccgtcacttaggagagtagaggagaactgccactccagagctgagctttgcaggaggaactaaagattcttccagagttattgtcagaaaaagaaaagggagggagtagagggggagagagagtgagagacagcaacacagcacccttttcccttctgcaacccactaatttcctgtagtgcctcctatttgcaggaagctaattggcaaaggagcttgagaaacagttttcagattcccagtccccagcattacggaacagagtgaaagggtaggcatgtagctgaaaaactacaggtaaataactggcactattaaggacgttactaaggaccaaagtcagaatcatggctggcctccatttacttaggagaattggaaatgagaaaattttcagaggccaaagtttctggtgagtgatacacacatatatagacataaatgtgcatatagggatatgcagatatgtgaacctatgtaagattctctgtggtgggtctggtctactttggccagtgaaacactagtgtgtgtgtgtagtgtgtgtgtgtgtgtgtgtgtacatgacagagagtgccactctgcaagagtgaggtgatattcagatggaatgctagaatgctgcagaaaaagaggttgttaaaatattaaaataattctttactatttgttaaaaaacacaaaacattgcgctcagctctttcaagggacccctggccatcatggcactggagagctaagggtgggcattggaggtgggacaccctggtgccccccaaccttccagccaggcctctgtaactctctcacattggccttcatccagactgttccactggtcagagcagaccaagaccagccccagtgtggagatgggacatctggttccagtgctagtgtgctggctggaactccctcagacccaccttcacatagctgtttgtaggaattgcatcctccatggtacactgtatatgtggattattaaacattttgagcatcacctcagtatatattaggttggtgcaaaagtaattgtggtttttgccattactattaatgccaaaaactgcaattacttttgcaccaacataataagtatgtctacatgtatagacacacattacttttgggcaaagccatctaaacacaccaatcttgcatgttgctttgttgtttgaataaggggacatgtagatataaaatacggattccattaagtattcagaaaatcctttgggtgcctaacataaagtctttctaatagatatttggatatatctctgagtatctttaaatggatttaaattaaatgaaaggtatcctagaatttacacttcctactggcacagtaaggaaagtaccacaattagtgcttcagtatttttcatctgcctattcctacatgtaggccgaagactatactacagatcatttgcattcctatgtactgccttataaacatgtacttatcctacagagaagctgaacacatttccttgttctgcgcttattacaggttctccatctttggggtggtggtggtggtaataactttattcttccatttagtctgtggatctgggataggatattcaagaagagaaatgtaggctctcctgaattttatgatcgggacagctgttcctgggaaatgacacaagaatcccaattaattccccaaaggtcacgcaattgaaaagtcaagagatggaattgattgaaagtgatcatcaacttgacctagactttttccagtaactgaaaggacaagaggcttttgagccaagtattgtctcttgccaaatttaattttttcattttggagattacaagcggctttaaaatattcatgcgaattcattcttgtttctacttctagaaaaaatagaactttctcaatagttgctgggtttcaattctttttctcatccaagggccttttgaaatatttaaaattatcaaaatattattacaattagcaagtcttctaaaagtaaaaactgatcccactgatattattttttaaaagttaatatttttgaaggaaattcttctgagaaaatttcccagaaagtgttctgagcccaagaacatatctgaattttctatcagttataatcatattctgaaggttttggcagaaaatttgggaactagagaaaacgcactcataatattgctacataatatatacttctgttacagtttattaatttgtttttctctatttctgtactgccgtaattgatgtttacatataatttggtacaccaacctttacagtaacatattgttttgctactgtctttatagcctttgttaccatgattttaactgctgtatagtatttcaagtaagttgtatcatgattgatttaatcactgcttctactcccttcctcaatctcactttgtccttgaatcactggttctcttattaagaccaacgaaaataacattggagtcagagccaaatgacttggacggtgtagctttgccaaattccgtaatctccttagccctgtttcccatctatcatatgtgaataacagtgactggcccctgcctacccccaaacacttaacctgtctcaaggaaaaacgtaagacctgtcctctattacttgtgatttccattaaataaatggaatagatcaattaaaccaggctaagaaagaagaaatattctcaacttaataatgaaaacaatttttaaattatctttctaaacataaataagctatggcaaattgtaattaattacctctgagttttgtttcccccaattattttcagggttctggtaggtccttacttatctaatgtatttttagacttgggacccttttcttctttacaacgttttttttttttttaatttttaggcagagtctccctctgttgcccaggctggagtgcagtggcacaatctcggctcactgcaacctccacctcccaagttcaagtgattctcctgcctcagcctcccgagtagctgggattacaggcatgtgccaccacacctggttaattttcatatttttagaagagacgggatttcaccatgttggccaggctggcctcgaactcctgacctcaagttatctgccagcctcggcctcccaaagtgttgggattacaggcatgagtcactgtgcccagccctttagaaagttttgagatggctttctgtttaatgtctgtagaccaacctgaatatcaagggatttttttttttcagatggaacagtaatgaaagtatcacaattagcaagttttctaaaagtaaaaactgaccccactgatattatttttaaaaagttaatatttttgaaggaaattcctctgagagaatttcccagaatgtgttctgaacccaagaacatacctgaattttctatcagttataatcatattctgaaggttttggcagagctgtcttggaaacaaaagctgaaaaaggcaaagggttgaacagtggacacatcttttaaccatatgatctgggaatgccttaggattgctagtaaggttgctttctataacaaggtgcttactctgtttcttctgaggctaaaagaaaacctttatcttaaaatataatcaattataagattttggccagcgcggtggcccacacctgtaatcccagcactttgggaggccaaggtgggcggatcacttgagtccaggaattcaaggccagcctggccaacatggcaagaccgcatctctactaaaaatataaaaattagctgggcatggtggtgcatgtctgtaatcccagctactcgggaggctgaggcacaagaatcgcatgaacctgggaggtagaggttgcagtgagctgagattgcactgctgcactctagcctgggtgacagagcgagactgtctcaaaaaaaaaaaaaaaaaaatatatatatatatatatatatatgtatgtatatatgatttctttttattatgaagcatttcaaatgttggaacatgagtaaaataatttgaacacatctattttaacacatagtaaacatattgccatattagctttgtacatgcacacacacattttaaatgaacagatgcatttgaaattttgtctgtaatcttccttgatctaatctccttcctctgcgtctatctccatctctgcatataaacactaccttgagttcagtcttattattgttattcccatgcctttctttatgcttttgctacataggtacgcatccatcaacagcatacagtgttgttttgcatgtttaaaaactttaaatttcctcatagatacaacttaccttattcactctgcataatttttaagattatttcatgttcatgcatacagaacaatcatgtaaactgttgtattgccttccattatgtgaatataccacaatttgtttatcagcccctcttccctgagcaagcagtttgagggacaatttaaagtcatagtgttataatttgttggccaagcagaacacagagggtgccaggaatcaatacttttatttctgcctttctccatgtgccttcagttattttactccttcctttatattttggcttggtctcctggaaagattgttaagatgactccttaacaaaaacttctccacggacatgagaacccactctgtgttagggaggagctaaatgtgagccagacattggtcaacaagtaggtgactgtcgagcctattaccatcaaattgcatatatacattcgtatctataatgtaatgccttgtgggtttcatatacacgagtattttactttttgcttttaaaagactattaaagttataaaaattacagtttataagaatttggttacccttggttatctccttattcaaatgtgtatttttcttaatttccatagtaatatatttaaaaacccaagcattggaggtcactacaaacgattgcatgaacagctccacagatcttatttacaataaatagctaggttaggtattgctagttttgtagatggagtgcctatagaatggaaaccgtctgccattctccttccaaaacaaggaaaggaactaaaaaagcaattatgtctgtttccttgtcttaatagacaacattgttgtgagctgctaccagctttctgtgttcccatgcaagctataatctatgatttgcctctgtaatttcattaatatttagtgaccagagactttttgagtgttaacagatacattctgttaataattattctggtgacttcattgtgcttatggtggaaaataggtctctgaatcacatttattgttttcctttacgaacaactaccaattatttgactaaatcattgtctataagctaaatgagttttcagccaactaaactgcatgttactgaaaaaacttacgtgacaaattaacaaagtacacattttaaaaaagatcaaggactcgtgagccaagaaatttcaaaccaaagataatatggtttataaaggttgaagtagatttttcaattagaaagtaaatggaacgcattgtaaatgactgcagcttctcttgttgtgtttttactgtgatccagaaatgactatattgatttttgaagtttttacgttaacaaaatcactgagactaaatttcatggctttgtgacttctgggtcaactgataacagctgagagaggctgtgactgatgcagcttctctgctagttgctccttcctatgctgaagtatttttttagagccatcttttatctttacttagaacaatgatgttgtggtttgttttattcagatcaagttttcagaagccgactactttggcaacgtcctacaaactcgcaagtatttagcacagtctgatttcttctggctaagaaaagccgttccaaaaacagagtgagtattaaacaaaaaaagttaaatagataaatacattggtgagaagcggagtctctttagattaaactttgtaattcccctcaagtcagagtagctggcttgccagttaacttgttttagcaaaatctgtgtcatgttttgccaactcttattttttatattacgtgattcagatcttaagtctaattacaggtcccccatttctagcatcaacacatatcaagagaaggcttattagaatgcaaacattaaagttatgtctagatctagttatgaatatatagagagggaataatttctctggatttttacattcatgtaataacttttgaagaccttaaaaaagaataaatacttaaactatgattagaaatgtcaaagtaaatgtatagaagcaactagaaaatatttgttgaggtaatgcctatcaaagaactgatagctatattgtttttatctaatagcagttatgatttatttgccttcctctcagctgcctataggagtttttcctacagataggagagtttccttaggaacttttaggcccagagcccaccagctacgatttcatcccttagcaaaatgtcagtgatgaatgtagcagctaacaattattatttgtttacattgtaccagaaagtgctttacaatttttaattcattttatcctcatacgaattctgtgtggtataggtactgttatccccattttacaggaaaataaaaggcttacaactgagaaattcttcagcttaggtttggatcacattttgttctgtctgctggtgcttttgattcctgggactggattctgttctgctaaggcccacttctccaatgcttttttttctctctgttctccagattggataatttctattggtctggatttcaactccagaatttctttttttaatttaattgtattattatttttttaacttattttttatttcaatagattttgggggaacagatggtggttggttacatgaataagttctttagtggtgatttctgagatttcagtgcacccatcacacgagcagtgtacatgtatactgtatcagtgtgtagtcttttattcctcacccccctcccactctttccccctaagtctctaaagtccactgtatcattcttatgcctttgtgtcctcatagcttagctccctcttatgagtaagaacatacaatgtgtggttttccattcctaagttacataggataatggtctccaattccatccaggttgctgtgaatgccattatttcattcctttttatggctgacaacttcggaatttccgtttgttttttgtagtttctatttctctgttgtgattctttgttaagtcattgtcatcatattttctattaattcttcaaataaagtttattttaattctttgaagtcatctataatagtcactttcaagtctttgctaaatctaatatgtgggctcaaactaactagagttagtttctattgattgcctttttattaaattaattaatttttttttacagtttttcctttgcttaacattttttgttgttgttgctaatgacagtttagatagcatgttgtagcaactctggattctgatttatttttctgaggctttttttttttaaaatcaaaagtaactgtcctaacttatactgccgaatagatcttctctgtggtatgtagctgtcgatgtctccactcagttttttaactcttatttgtagttattagcctcacttcctgctggttgtccctgtgtctacatagcttagtgctcaatcagtgattaggtcagagcttgtgcttaaacaccttgagtccatagggcttctaccctctgccagttgctctgtgtgtgggttgggagcaccttcaaagttatagccagttctcagtccaccttcaatttcaccttccaccaggccctcactggtcttccctgcacatgtgcctagtttcccagtcagccagggatgtgtggagtgcttatttggcccttctattactatttcagttataggatctctcttttaaatttctgactgggttttcctcgttagttttctactaagttggccattcaaaaattaaaaaaaaaatgttgtgggtatgtagtaggtgtacgtatttatgaggtacatgagatatttcaatacaggcataaaatgtgtaataatcacatcagagtaaatggggtatccatagcctcaagcatttatcctttctttatgttacagacaatccaattatacagttttagttatttttaaatctataaaaagttgttgactgcagtcaccctgttatgctatcaaatagatcttattcattctatctaagtatatttttgtacccattaaccatcccctcgacccagtacccttctcagcctcattctactctctatctccatgggttcaattgttttcatttttagctcccacaaataagtgagaacatgtgaagttttctttctggggctggcttatttcacttagtattgtctagtttcatccatgtagttgtaaatgacaggatttcattcttttttatggcttaattgtactccattgtatatatataccacattttctttatccatttgtctgttgatgaacacataggttgcttccaaatcttggctattgtgaacagttctacaataaacacgggagtgcagatgttccttcgatgtactgattttctttcttttaggtatatacccagcagtgggattggtggactgtaaggtagctctatttttagttgttcgaggatcctccaaactgttctccatagtggttgtactaatttacattcccagtaacaaagtacaagggttctcttttctcaacaacctcaccagaatttgtttttgcctgtcttttgaataaaagccattttaactggggtaagatgatatctcattgtaatttttgatttgcatttctctgataatcattcatgttgtgcaccttttcatatacctgtttgccttttgtatgccttcatttgagaaatgtctattcagatctttgtgtctatgtgtctgtttttatgccaatatcatgccattttggttactatagctctgtagtataatttgaagttaagtaatgtgattcttccagttttgttgtttttgctcaggataacattggctattctggatcttttgtggttccatataaattttaggaatttttttctatttctttgaagaatgtcattgatattttgatggggattacagtgaatctgtagattgcttttggtagtatgggcgttttcacagtattgattcttctaatccattaacatggagtatctacttttttgtgtcctcttcaatttctcgcatcaatgtttttatagttttcattgtggagacctttcacttctttagttaagtttattcctaggtattttattttattcgtagctattgtaaatgagattatcttcttgacttcttttacagatcgctttctcttagaatatagaaatgctactgatatttgtatgttgattttgtatcctgtaactttactcagtttatcattttaatagtttttttggtagaacctttaggtttttccaaatataagatcatattgtctacaaacaagggtaatttgacttctttctttctaatttggatgccccttatttccttctgttgtctgattgctctagctaggacttctagtactatgttgaataatagtggtaaaagtggacatccttgtcttgtctagatcttagaggaaaggctttcagtttttccccattcagtgtgatactaactgtggctctgtcatatatgactattactgtgtttaggtatattccttctatatccggtttttcgagagtttttatcctgaaacgatgttgaattttattaaatgcttctttagcatcagtttacatgatcatatgccccgtgtttctttccactgtgataggacagcactgagttccagtgcaaagtcccacaatcaccgtactctccttcccccaagcgcagaggtttttctctctgtgcccatgtggctgctgctggggaatgagggaaggacggtataggcaattcaagactggctttcctaccctcttcagtgcctctttccttgatgtgatgttaaaaccaggtattgtgattgttcacctggattttggttcttatgaagatgctttgtgtgtgtgtgtgtgtgtgtgtgtgtgtggctagttgttcaatttggtgttcctgcagggaggacacttgctggaggtttctacagccttcttgctctgcttcatcctctatgttggccatttttatctgacaaagctgtggcttttcactgccacccccagttgagtctacccactggggcagcaaagctgctgatttcccagccagcctttttctgacaaaactaaggtctcactgagctaggagggacaggagtagtctcaggcaaaaaggccatagtgcctgctctacttaatgccaagttctagcagtttttaaatattaaattttgtttaatttattgctcccccttgatgaattcccagattcctaaaatggttatttgttgacaatgttgtccagttttgtacttggtttttgtagaaatgatttgtcaaccttctcatgccattatacctgcaagcctggcttccatggattacaattttttttttcatggcccactttttaaccttggctaatattctgatttctagatctttgactggctgtttttatgctgcctagtcttttgctactctccctttcaagtccctgttctgtcctggcttctagaaactctgagcccctgtgctttcccttggcttaagtggtgattaccacttctccctcttatgtttccatccggccatccctgctctctgcccttcaaaccttcctataatatgcacctgaaaaattcattggaggttactgactttaagaggtaggcctaaagctgaatctctcccctacctaaccctgactccagtcaaaagcacaaaggaaaacagctttagaactgctttgaaaaatgatagataatggtttaaagccatttgctccactgtctttggttctttcctctcatcacgttatttctcagtccacctatcctgtttcattcccagtctaaattattcaatagttttagatttaggcttcttaaatccaatactcaaatctgatgactttggcaaatgatttccagtatccctatgaccatctacatgtaatacggtagtcacagatctatataatcttgcccttcaatatttgcttcagatcagttccaactcttttttaaaaaaaaaaatctgtggaaaattgaagggtttcaccaattttttggtgaattttcagggtcttctcaggggctcctgcatattggcaatacagtcagtctaattgtttgatttcaaaatgtcattattcatttagttgtgtagaaaggcctggattagtaattgaaaaactcctaaatgtgttatctttaacatcgtcctaggatactgatgaactttcagattctaatggtcttaactatttctaatattttattcatgccttagaaatatactggctttgcaggcttaggcaaactgagatttgtgtggttttcttttctgtcattgaaaaacaaatagctctttcacaagggtattaaattggttaacttttgggaaaagttctccagaaatggaaatcagtgcaatgcttgtaattcttgtttcctcagactatatgtctatttcagggaaataacatttagaaatttaaggtcttctttgcatagtaaagggatatgagtaaattccttttccttcttgttttttttttttaaaggaaacatctggctggaccttttcaggcattgtagagacttttagcctcatgatactcattggcttgaatggacatctttcaggtctgaaaattcatgagttaatcgagtggggatcattctggagtagctctactacactagtttactttgaacagcatcatgattatattttcacaaagccctgaaataacgttttgcttctttgtgggtgtaggagataaagaccctttatcttttattctcatggaatccattttagctgcactaatgtgcattaagaagtttctaaggcgatgggaaatgtcagcaagaatgaaattaattgggtggtcatccctgaaggtacatatttaggggttggttcacagaattgtcacttcatcagcttgcttaaaaatagaggatttacttactgctcggcttgagttgaaagtaatttctttccctcaggatcaccttctttgacagaaattattttagcccgcctcacttttaactcactctcattctactgagaccaaacacgtctgaattctctatcttttgaaaaatatgtaaaaatgcattaaatgtctttataaattatgttcctgcccagaacttttgtttgcaaaagcattatctatagcatggaatgtgagtgatataatctgcaggatattaataagaaagcaataaatacactattgcttttccattccatattccctagactatctgtaggagttgataagaaaaatgtaaaactttagcctgatgtatatctattttatatggtccaaagaaataggtgtaccaatgtctttttcttcagattcttgtattttggtattatattccttttatgtatctcattctccagtataatttcatccccattattgtgggatttgaaatttctatgagacctctccttaccttatccaccaaatcctttctcaaacacagactgcagaagcaccctaaagacatagtaagaagaatttaaagcacttgaatgatattctctgtttattgaagtggatgtatacatgcaataaattcattttaatggatttagtgatcttctgttcagcacttaccatttggacaacagtcaaagcccataagcaacttaaaatcttgttgggacataagctgtgcaaactcagatgccttcaggggccagtcagttaacaaatggttgacctacatgggtgtaaacaacagggagtggtagggactgtagaaaactagtaattacacacaccacttgaaggaattccaattcaatagtttgttaagccattgtgttgggcaagcaaaacagttttctgggaagattcagcccattgggttggacttagtctgtggatagccaacttttcagcattccatttatctattgctgtgtgataaacctcccccaaatttagagtactgaaacaacagtcattatttttctctctcatggttctgggggtcactaggctcagctgcatggttctcgtttgtggtttttttttttttttttggacacagagtctcactctgtcaccaggctggagtacattggcgtgatctcggctcactgcaacctccgtctcccaggttcaagcgattctcctgcctcagcctcctgagtagctgagattacaggtgcccgccaccacgctgagctaatttttgtagttttagtacagacagcatttcaccatgttggccaggctggtttcgaactcctgacttcaggtgatctgcccacctcagcctcccaaagtgctgggattacaggcatgagccactgcacctgaccatttgtggtctttcatgtagttacagtcagatagtggctggggctagagtcatatggaaggctacctctctcacatgtctaatggttgatgctgactgttgactagaacatctacatatggcctcttcatgtatgttgggtttccttacagcatgttgattgatatagaaagttcaaagagcagcttttctgagaaagaagaagggagggagggtgtgtttgtatgcatcagggggaagttgtatcacctttaattacctagccttggaagtcacactgtcatttctgctgcgtattattctttagaagtgagtcactaaggctaacccataatcaaggggagaggaatttagattccatctcttaatgggaggagtgtaaaaaagttcacaaacacatattaaaactagcacatgtagccttacattagagaatagtaaaactaaatatataataaacttggatgtaatacgggagatatacaaaatgtttaacagctggtttggcatgggccctgaacaaatagaagaaataacagcatcaacaactggtaggatctactggtgcagctgcttaatatcagctctgggtattatcaagtctccatacgtgccctagagtcaataagagccctgggaggtcaggaatggtaagatcatgtgtctgaaataagatgttttcgttattcttgttgaagcttcagaagccccattaaggtctagtttcagagactggttgtttggtttgctttgtctacctttgtctaccagcagttaggaacattttccctgcatggcccttacctgaatattttaaaagtttgttattttaaagagaggggagttgggaagaacaaaaagagaagggacaagctctaggaatacacgttatcttttgtatgtattatgattcattccagtgttatttagaagccaaggcacccacctggattttcccctcttgacctacaaatgttgggttctttggatagtgcattagtttcctattgctactgtaacaaactcctacaacctaagcagcttaaaacagcacagatttattatctcacagttctctagctcagaagtctagggtagcttggttgttttctctgctttggatttcataaggctgaaatcagagtgtcagccggctgggctcttatggggaggttctgggaataatccccttccaaggggattcaagttgttggcagaatccagttctttctgattgtaggggtaaggtctttacttccttgctggctatcgcctggaagccactctttgttctcagagggatttatgcagtccttgcccattgcccctacatcttagagccagcagcgtgtcaaatccttcttacccttcctcctctccgacttcctcctctgttgcatctctctgattccagccaaacaaggttgtctgcttttaagggcttgtgattagattgagcctacctgaataatccaggataatctctctattttaaggtccttaagcttaattacacctgcaaagtccttcttactatgtaatgtaacatgttcataggatccagggattaggacttggccataattttacctactacaggtagccaagttaggtcaatagaggtgctttccccttcacttgtttcctcaggaaagtaggccaaccagcaagtttatgttaaacactagggcttaattgaaataccctaaatttgaaggaaaagaatatgcattttatggaaatatgtctaggtttcggttttgaagagagaagaggtgctctttcttgatttccagtaatgtctacagtataatataatgcttaggcgaactggtttgaagtcagacagaccaggcctcgtacaagcacataatgctcataaatctcattatcctcgtctgtgaaatgggctaataattcctatgttgccatggggaaaaactgatgaatagaaggtgcttaggacatagtaagtgctcaatgaatgttagctaaatataatgataatgataacagaatgacatattcatagacttctttgtagctggggagaaggtatgagtttaccaactagtatcaataattgggtttcctattagtttcatattaacctgatataaattaatttgttagtctgacataattatcctattagacgtaaatgagtaatacaattattctagaaagggatttatacaagttttttttttctttttaatttttttagagactggaacttctgggctcaggcagtcctcctgcctcagcctcccaagtagctggaactatatttgcatgccactgctgggcctaggagtttatttttagcaattttgcttaagatgaattgcttggttttaatcataacaagcagtcactgaaactcacaaccatctaagtcagggtttggccactatggcctgtgggccaaatctcacctgctgcctgtttttgtgtggcccatgagctaagaataatttttagagataaatgtttgcaggtggtttgatgatggggaagccctaactttgttctgttttttgtttttgttttttaattaaaataacttttgttggtacgtagtagttgtaaatatttatggggtacatgagatattttgatacaggcctgcaatgcataatcatcacatcatggaaaatgggagtatccatcccctcaagcatttatcctttgtgttacaaacaatccgcttatattattatagttatcttaaaatgtacaattactattgactatagtcaccctgttgtgctatcaaatactaggtcttattcattctttctaactatacattttttgtacccattacccatccccacttctcccccattcccctaccgcccttcccaacctctggtaaccatccttctactctctatctccacgagttcaatcgttttggtttttagatcccacaaatacgtgagatctcacaaatacgtgagaacatgcaatgtttgtctttctgtgcctggcttatttcacttaacataatgacctccagttccatccatgtgttgcaaatgacaggatatcattctttttatggctgaatagtactccattgtgtatatgtaccacattttctttatccattcacctgttggtggacacttaggctgcttccaaatcttggctattgtgaacagtgctgcaacaaacatgggagtgcagatatctctttgattattttctttcctttgagtatatacccagcagtggggctgctggatcatatggtagctccatttttagttctttgaggaacctccaaattggagaagcataactttgaaccccaattaagcaaaaggttatctcatcccaaaataattccgttattctcattaataggcatatattagaaataattgtactcagctgggcatggtggctcacgcctgtagtcccagaactttgggaggctgaagtgggtggatcacttgaggtcaggagtttgagaccagcctggccaacatgccgaaaccctgtctctgaaaaaaaaaagagaaataattgtacttgattactattgttattttttggatttcatcaataaaatttgtggacagtttgctcttaagtacctacgtaatatccttgattttgcctctttgcctgtaaagcctaaaatatttatgatctcactctttacagaaaaaaatttgctgactgctgatcccagtaacctattgtgcatttaaggtttgggtgtagactccttttagatagaagggatcctttagatgtcctaatgcaatgccttaattttatagctaaaaccaaaccccaggaaggtaggtgactcttcccacacaattcagctagttagtgatagaggcagtacactttccactggagcaggcagaccctctgggtggcatagttggactttattcatctttctttaaatggacctctgtgttgtcaccaatccagaacttttaaatggacaggccagaggtaatgcagcatagaaacccaattgtccattcaacccattgaatagggcctggcaaatatatagttgctgtgtttccatttgcagggacagccctttagattctagaatttctctttaaaactttttcaaaagcactggtgtgctgactttttttctgttaagttagtaacaataaataactgggcatgttaatatattttcattgagccatgttcagtttaggatgagattgttcattgagcagtacagtagccccaaactgagggaataatttcccctcatgtccaacatccccattgttccatgttatctgctaataaacccagccatgctgtgtttgtctttgcttccctcctgcctgtataatgatgattgctctctggcatttgtttctttttctacaggtggtttacaaatccgacgactgtcaatgccttctacagtgcatccaccaaccagatccgtgagtacgggttccttgtctccttggtaacctggtataaaatgcaaagaacttttccatgactatgatggagggtaagacatttcttatttcccccaaaagtggcagggtatgctggtgaaggaaggttgttctcctacctatatgccaaattttcctcactctcttcaccttaccagttttttttaaagctttatgtcaccactgattgaaaaaaagtcaactacagtaaaccaaattaaaccataatgaagtttgccatgaaaaggagcaagtttccactttcctttcataatggccttactgattttgtccatgccattttattcattcctaggattggtggggaaaacagcaggtaactgagcagattgtagaacctgagcggaccatctgtatgtaagaaagaagcttggaaatattcttattaacgctaggaagttatgtcttgaggttttctacttacatgtatcaggtatatgtaattaaaaataccatgataaatttaaaaaattattatttttattattttttaaagacagagtctccctctgtcacctaggctggagttcagtggtacgatcctggctcactgcaacctctgcctcccaggttcaaattattcttgtgcctcagcctcctgagtagctaggagtacaggtgtgcaccaccacgcccagctaaattttttttatttgtatttttagcagagatggggttttgacatgttgactaggctggtctcaaactcctggcctcaagtgatctgcccaccttggccttccaaagtgctgggattacaggcgtgagccactgcacctggccttaaaaaattattaagatctgaatggcacaaataaaaagtctgacagcttccagccttggcaataaggacacatactcactgctggtggaaagatagatgggctcatccactttgcagggcaatttgacaatatctcaaaaagctgaagttgtgcatgcatacctatgaccatgatgtgtgctcctggaatgtgctctaatgttgtgagtcttgaaatgtggtccttggacctgcagtaatagcatcatgggggatcttgttagaaatgcaaattcccaggccccaccttaggtctattgatcaaactttggatgtggagctcagaaatctggtgcaataaaacctgcaggtgattgtaatgtatgctaaagtttgggaacagctgccctagagaactcttgcacaaggcataaagaagcccatgcaaaaatgctcataacagtattatttataatagtagaaaaagcaaaataacctacatattcctctgcaggaagatgagtcacatgtggcatattcacacaaaggaataccatacagcagtgaaaaatgagcaacatatattaacatggatgaatttcacaagtaaaacaacttgggaaaatatatcaagtatgatactatataaataaagttgaaaatcatgcagaacaattctacacatggtttggaggtccatccatttgtagtgtaagtgtaaagacattcatgagaatgacaaacaccaaattccggttggtggtggcttgtcttggggagggtgggccactgttgctcaaatccttgctggtttctcctcatctcccatatctcttaatgatggcatgccccaaggctcagtctgcaccttttctgttctcttctctccatctttgctcacttgcttggtgataacatctaatctcatggttttaatcacatttctacagtgttgaatgcaggggatggaatttatcacccttgttcataccactactatctcccacctggattatggtaatagcctcctcattggcctccctgcttttgttcttaccccccttcagtctattctaaatataatattgtagcgattttaagacgttttacaatcacatcgtgtcacttctttgctcaaaagcttttatcagcatcccatctcactcagagaaagagccaaattatttataatggccttaaggtctgttatctttctgcctgtacctcctgctactctcccccttcctccctccttctgttccggccacactggcctccttcgtgtttatagagcacacctgacacgctctgctctgggagcatttatacctggggttggctttctcttggaaaacttccccaagtgacctgcctggtttatgctcccatttccttcaaatctttattcaaaggccaggccacctccttagggaggcatcctgccttccctctggccagttggccagtctgccgtgggtcctccatactggccgttgttcctacaggactctggtcagaggacagccggaaggctgtggctgctcactaccagctggcacatcttcttagagccgccctcgtgtggccactgttaggaatggcagtttctgcccgacttcggtctgagagagaaatgaacagaaagacgaaagacaagcagatggcgggatttttttatttatacattaatttacataaccaagtaagttgttaaatattttgaatgtcacttcttactgtataaatattcattatcacgaaactaccattgctttcttaaggccctaaatgccaacttgagaactaagttgcatatgttatatgggaacttatgatatttgagttattaattataactaatacttataataatttattattaattataatcacatttaggacattctattgggaaatagaaattgtttagattattcacttaaaaacgttttattgtctaatatttggtacatgcaaaagaacatgtaacattttggcacatataagttataaagaatatatgaaaacatgacgaaattaatatgtgcctacgacgccctcaccccatcaggaaccatccctccctctcaccacagaagtaacactcttctgatttgagggtttatcatttttgttttgtttttttaaaataaaactttatttatataggtatccctaaagaatatgttgtttatttttacttgtttcttagtataataaaaatggtatcttactgtatgcaatcttaaacaactgcgatttttcagtcaacatgtttttaggatttgttcgtgtagcatgtggtggtaggttgttttcatgttcactgctgtataatatttcatgactgtacccccagattgtttattcttctgttgtccagcctatgagtccccacacccaggtttttgcttatgaacagtgctgctctgcatattcttgtgaatgtctcttggaacaagtgtctgagggtatacatccaggagtggaattattggctgataggaagaagttatctaccagataatatcaaatgttttccaaagctggtgttccaaagtacagaagtgtttctgttgttcctcattttcatcaactcttggcattggtagatttaattttcaccagtctagcgagtgtaagagatcagctctgatgcaagaaaagccgacgtttccgcattcactttaaaatgtcactgaaggcttactgctccttggggtacttaagtgtgtctaataatagttccatctccagggttcacccctgctcagcctttttcttgcctgggaagggctaatcctatcagaggtttactgaggaagaaaccatttcagggtaacccaatggtttcatgaaagctcatgggcagagggttttttttaaaatgaacaatttgaaacagtattttaattaagagattcaagctgtttctgttttcctaatgaccagtgcttgctctcattgtaaattacattcccaggcaagatgacaaggaatcctttgggtgacttttttttcccctctctcctttctgattttctggactacaaattaagacaggtggagtttcttcttacacacttccccaccgggtttcctgggacttcccccaccctacaactgccttctttttgcttcgctgaagaagtgaaaaattgaggtgattctctaaaatgaacatctttattgattaggggctgattctgacagcatgtggccatctgtttaattgggttttacatctaagatgtaactatacttagtaacgtgatttatgacaatttcattcagttcccattatcattttctgatttatgctacttaaatcttcttctgcacgcaatagagacttgaatagaaaacagaaaaacctgtagttgttttttctttttcaaatccatgcctttgtgtggaaccctatgatttgtggccatctttcaatgttagatttttacagggtggttacaacttcttatttttcttcccttgtcaagctgggtagcaacgtctctagacatggcatgtagtgtgaaattataatgatttaaatctgctgtatgaggagttaaactcagtagctgtcataaaatttaattatatttgaataaggtggttaaagaggaaaacacaaatctgaaatgattggtgcttaaccctaactttgtgataactgcgacactgatcttgctgcttttcagagtggcaaggtgagaacatgaatcagagatctagtttgtatggccttagtcgaggtttttatccttccagacccctattgtcctgtctgccacatgttgaggctatctagcccatagggttttaggggaagatttaatgagacgaatttgtaaagtgccagcacattgccaagctcagggcttgtatatctaaacctggcatgccaggaatccctgcgataaccattgtgtcacaagacaaacagcaaaatataaagatcggcaggggggattatttcaaacttttgccctcaagagatcttaggccgggcatggtggctcacgcctgtaatcccagcactttgggaggctgaggcaggcggatcacctgaggttgggagttcgagaccagcctggccgacgtggtgaaacctcatctctaccaaaaatataaaaaattagccaggcttggtggcaggcgcctgtaatcctagctgctcgggaggctgaggcaggagaatcacttgaacccaaaaggcggaggttgcagtgagccgagattgtgccagtgcactacagcctgggcgacagagtgagactctgtctcaaaaaaaaaaaaagagattttattataatgttccacattataatatgtatgcatgcaactgactaaatgctgagtaaaagaagccaggtgtaagactaaatactgttctgtttcatgtgtataaagttcaggaacaggcaaatacatctatatgatagaagttaaaataatgactacctttgttgggggtattgactgagaggaggcatgtgacacattctttatcttgatctcagatgtggttacacaggtgatacaagagtaaaaactcaccgtgttctatcattaaaatttgtgtctggctgggtgtggtggctcacgcttgtaatcccagcactttgggaggccagggtgggaggattgctttaacccaggagttcgagactagcctgggccatatagcaagaccctgtgtctacaaaaaacaacaaaaaattagccaggtgtggtggcatgcacttgtagtcccagctactctggaggctaaggtgggaggattgcttgagcccaggggtttgagacagcagtgagctatgattatgccactgtactccagcctgggtgacagagcaagatcctgtctttaacaacaacaaaaatgtatgcttttactgtatgttaagtgacacctcaaaataaataggaacactgctccttttctccataaaaatgtttggaacagcgtatagtatgcatggacatctggagctaataataggttgcctcaggctaagtctctagatgtgtagaccagggattggcaaactatttctgtaaattgccagatagtaatatttttggctttgcaagtcatagtgtctttgttgcaatttctcaactctgccatggcagccatagacagttcataaaccaatgaacctggctgtgttccagtaaaactttatttacaaaacaggtggcaatattcaggtagtggtagtggtgggaagagtgaacagctcatatttggttttcatttctactaacatggattggtctttagaagaaaattcattttaagtattcactatcaatgaatatttgaaaagcgcctcatttaagtatttggtttttattttcatacatctcaaatcaaattaaagaagtatcttaaacagataagatcttggcttgaaaacaagcatggcctaagggctaaaaccaatgattttattatctttgctgttatacacaagggatttttttcccctcagtttaatcacagatattctgctaaagaagataagcctttgtccagaggctgggcttatgggggcatcgaattatggaattaacctggaaatcaaacatagatttgttttgctgttaaggaaataactgtgtttcaaactgggagaatttctcatacttcactggctctgcctgaaaccataaagtaaaagctaagttagcaaatactcacctgtggcttctcttggaatttaatgaaattaaatctttgaatccacttgatgttccatctggggacatgagaatataagactaatatatagaatttgggaatagtcttccattgtttttagagctagaaagaaacttaagtggtcacctcatccaaatttctcactacctaaaagagatcctgacactcagagcaattcttagtaattttttttccacttattcacttgattttcaagtgaattttcaaggccccaatgattttcacttcccggtattcattcccctgtctagtcccctgccacactgagtaaggcttaccactgtaactaataggatgctatggaaattctagattatgacttctgaggctgggtcataaaaaacattgtggcttttgttttttggataatgttcactctgggggaagccaaccaccacactgtgagggcattcagggagctcacacagagatccacatgtgaaggaactggggccccctgctcattaggagtaccatgtgagtgcgccatcttggaagtagatccccagtgcagccaagctttcagatgaccgtggcccaggctgacatcttggctgcaacctcacgagacactgatacagaaccacccaaataagctgtttccaaactcctgacccagagaaatggggagatagcaactatgtctggggatgatttgttacacagcaagaggtaactaatatagctattagagcatgcccaggtactaactgagtttggtaggagggtatataactttgtgtggtttagtggttaagggtgtgagctctgaagtatgacagtttgattttgaatcctggcttggccactaataacttgcaaccttgggcaagttacttaacatctttaagcctcagtttaattatctgtaaaatggagctaatagtagtaaccatcctatagggtttttgtgaagattaaatgatactatatatttaatatctaatgttatctagtacattttataatctaatattagatacataatattaatatgtaatattaaatattaattatatctaatattaatatacatttatagttatatattataaattatacatataatatattatataatatttatataatatatatcaatatgtaatatataagtatatattaaattatatatacttatatatatgttaatattgtatatataatatcatttaatcttaaccctataggatggttactactattatatatatatataaaatgcttggtatagagtgtggttcatagtaggcacccaataaacattagctattagtccttgcttttgaggagctgggagagagagacttgttaccaggtcatttagaagacatcatggtgagtgtgcaacagaagggtgtgcagtgcattctgggagccacagtggaggggcaattaagcctgggggagtcaagattggattccctatgaaactgatgtttgagtggactttggaaagaaaaagaaatttctctgggcacagaagtgagattagggcatttaggaagaagcactgttgtttggtgcaaaggcgcagatatggcagaacatagcacaggaacagactgtgagatggccacaaatgctggggcacagcttgcactggtggaagagacagcaaagggagtgatgggagatgataagtggaaggaaggctttgtgggtcatgtcaaagaacaggccagagggagctagtatagtttttttgcggggaggcaaataacttaagttttacttctgtattggtctgttttcacactgctagtaaagacgtacccaagactgggtaatttataaaggaaagaggtttaatggactcacagttccacatggctgggaggcctcacaattatggcggacggcgaaggagcagcaaaggcatgtcttacatggtggcaggcaagagagtgtatgcaggggaactcccatttataaaaccatcagatctcatgagacttattcactatcatgagaacagcatgggaacaacctgcccctatgatttaattacctcccactgggtccctcctacaacatgtgggaattatgggagctacaattcaagatgagctttgggtgggaacacagcctaaccatatcaacttccttaatcctagtattaaagatcatggtctggagagggacagattgcagccactaagaccagttaggagttttgcaaatggctcaagagaaggacggggagggcctaaacttaggcaatgacaggggtgaggaggagtaggaagtttataaatcatatcccaggagataattgtcaaataactgcataatgataatacagatagcacagtgatcctcccttatccatggttttgcttttcattgtttcagttacctatgggcaaccaagttctgaaaatattcagtggaaaatgccagaagtaaacagttcctaagttttaagtcgtgtgccattctgagtagcatgatgaaatctcttgctgtccagctctgtgccacctgggacgtgaatcatctctttgtccagtgtatccatgttgtatatgctacttgcctgttagtcacttagtagctgtctcagttaccagatcaactgtcacagtgcttgtgcccaagtaacccttatgttacttaataatggccccaaagcataagagtagtgatgctggcaattcaggtatgccaaagagaagcttcctttcagtgctaaggtgaaagttctccacttaaggaaatttaaaaagaaatcatatactgaggttgctaagatctacagtaagaacgaatcttctatacatgaagttgtggaggaaaaagaaatttgtgcattgtgtgcgtgtgtgtattagtttggtactatctgaggtttcaggtgtccaccaggggtcttggaacatatctcccaaggacaagagcggggactactgtacttttctaacttttccactagggctttacaggacttccatcaaatggagattataactgttctgtgcagctaggctttgctgaggaaccattaatatgccaaccattatgccaggtactttaatgtatgttatctctaatcttcacaacagttctataaacttggtattatgggctcattttacagaagaagaaactgaagctcagagaggtgatgcaacttgcaaaagactgcaaaactagcaaattgcagagctgggagtataacccagcttatctgattgcatcctgtttatcgtcacactacactgttcaaaactggataggaaatgtgagaattacagtcacgtgataggctgggtgcagtggctcacgcctgtaatcccagcactttgggaggctgaggtgggtggatcacttgaggccaggagtttaagaccagcctggccaacgtggtgaaaccctgtctctactgaaactacaaaaattagctgagcatggtggctggtgcctgtaatcccagctactcgggaggctgaggcacgagaatcacttgaacccgggaggcggaggttgcagtgagctgagatcgtgccactgtactccagtctgggtgacagagtgagactctgtctcaaaaataaaaataaaaaataaaataaaaaatagccatgagatgatatacaggaacacactctgaaaaggttaagggtatgatataaatgtgttagagtaatcattattatatcaccccctcacccatgctgctcgttcactggttgggggattgtttctcttctggtatggaaacaagatattatagaatgtaaggcagccaggaggtgagagtgagaagtttagatggtccccaagtcctactgatttcatgtccaaaagggttgtggcatcaagcagttcattattgcctcttctaacgatgctgttctctgcaagctttttggccaagcctgtgatctccttgggtctttagcttatgggaagagtggaggaggggttattctgtaagctagcttaaaaggagtatttagatatactcccccaaaaggctttactttccaaagtttacactgagattttaaaagttttgttaagtgagctgaagttaagtcatgaacaaactttgaatagtttgtgaaattgacagatgatgcacttagcaagtctgtggaacacctgctacaacttttttgtttttgttgttgtgacagagtctcactctgtcacccaggctggagtgcagtggcccgatcttggcttactgcaaccttcacctcctgggttcaagcgattcccctgcctcagcctcctgagcagctgggactacaggcgctcaccaccacgcctggctatttttttaaaatatatatttttattagagacaggagtttgccatgttggccaggctggtctcgaactcttgacctcaagtgatccacctgcctcggcctcccaaagttctgcgattacaggtgtgagccaccatgcccagacctgctacaccgattttaaggcattcttgtcctggtctagttgaggaatttggaggtcctgatacagacccccagtttctgaagcctaaccaaggaggcacctgagaatggtgttctgggtagtatcctgggaggacaaaactagcttcatctggaatgctctgcagtctcatgggattcctgttaccatggtaagtcccagaaccaatgcctgtaaggatgcaatttgccgcttgcagggtatttctaaatgctgttttcagacatagtgcactggtcaggttggctgcagggctggtagtaggaaagcatgaaatgattatcagagtcaacctgattaaagacaggatgtaagcaagccagggtgaggtgagcatagggacctaaaaaccagccatgggaacaggagacaggatgtcagggagaaatctcattaattgaccttgatggtcacagtctcatttgtcttctctttaaaaaatcaattgttttttacccttatttacaaaaggagttcatatttattgtagaaaatctagaaaaattttaagtgaactaaaaatttaaaaagttaatatcatttaaagatagtcatggttaatacctttgttgaataccactgagatgtatgtttatctacaaatattttacagtttaaattaactagactcatccaacagtactactttttccccactgaacattgtaacatgaatattttttccatttattacatattcttccaagtcatcgagtgtagtgttcaattgagaaaacaccttaatttatttaattacttcccaatggacatttaggctgtttccctattgttaaagaaccctctgtattaataagttttgtggctttctgtctaaatctgagaccatttctttagagtaaattcctagaagtggaggagttgctgtatcaaatggtatgccccatttgagggttttgaaatgcatcttacccaacttctctcaagaaagcagtacaaatttgtatttccagtaacaacaaatgagatggtttaacctttaatgagttgcatcttaaagatactgttggaggaaatgaatagagagactcagttttttgtctaactgatatagggaaaatatcagtcacatttcattcttgagaccattattgcataaccagatatggttcagtgaacccacataagcatttgttgagtacctaccatgctcccaggcctgggctgaatatccctgctgctagtgtcagtttcaaatacttagtacagcaatcaataaatgagaggacctgttggaatatgagtagaatatgagacaccgagctttatagtggaaggaaattagtgttttctttgccagatgttaaactatagcagtggttctcaaagtgcggtccctggatcatcagcatcgcttgtgatagatggggattatctggccctacctcctgaatcagagactctgggatttgggcccagcaatttatgttttaacaaggtcttaaccaccaaacttctgcaagatgccaaagattgaggaccgctgagctataaaaaggcagcaaatgcagaagaggtcagacttgttgggtaaaggtggggtgactaacttctcctggtttgcctgggaccatcccagttttagcacagaaagtctcgcatcccaggagccccttctgtcccagctagacagggatggttggtcaccctggtaaagggtggcaggggtgaagggaggttctctttgttgcagcctaaaggtaattatggcagaaaaagaatagaagggccagcagagaaggtttcaagatggagggcagatttcagaagctgctttctgcttgtcagctctaggctgatagatgtggtggcaggaggttacctgcaggaagccagcagatggctaaggcatcttgctgaatcccttgacaggagtcacagctgttagaacttgatactttctggaaaggggaaggttggcattcaccaaactactgcaagatgccaacttgaaaaaaaagccatgattaatcttagcagtgatgacaatgaaatcattttacagcaaaaaccataaccaaaagtgctttgtaattgcagcaatttccatgtcctgactgatggccccctagattctagaatggtgtcgggcttatctgattacaagaactaatcctgaataagatgtaacattcattcttagagtaagcattcatcccggattttctaaagcaggtgcaatttaaactctttttgttctttactacagtcaataatgtataaggcatgtaaagtttcagttttgaaagtatagtgtgcaaaattttaataaaagtaatcatacgttacattgttacatgcatggtgttgatgacagaaagacaggagggctgatttatagatcagttaaacataagaaattccttatttttcctaaaccaacaattctgaacctgttttcatagtcgaatcacctggggagcttttaaaaaatgcttatgttcagggttccatcccagagatggtgacttaataggtttgaggcaggggcttggacatagatattaaacaagcaaaattccccaggtgatgtgcatttggggttgagaatactgtacttaccctgatataaaccaatgggtcccaactttagcatgtaccagaatagcctgaagtgctattcagtaggtctagggaggtgggggtgcaaacatttgcacctctaaggagtgccctggtgatgctgatgctgctggtttgcagaccaagatttgatcaccagtttcctaaaccattcctactccaaaccccagataatcgtacaaaccacatctgtcacccattagctagacatgtgaataaataactccctctcaaaacacttctgcacatctactcccacgtatccagtatttcttttctctactgagtttaaaacatatttcaattaaaaagcatactttagaaagcttggtataggtttaccttcctctttaggtcttgcaaaataggattatttgtcgagtggtatcctttctccctcactagattgtaggttctctgaggacatttgtttgttcgaaggttgcccatgtggcttaggacatcataggtgctcagtaaatgttagtagtcagtggttatgcatagaaattgcatcatcataaccaaacccacctattcccagtagtttttataatgggatctaaatagactgacactccaaaattaggatcataaaacgtattcacttagagaagtcgaagctattgcacaggacaagtaaaataatcaaagaagttagcagaaggtaactacaagggaatttcaccaagaaggacaataatgtagataagatgatatatcagcaatagccctgaaatgtggactgatacatagagtagtttagtaatataagcacacacttaaggcttttgaaaaaaaaataactgtcacaacttgtactggagccacattaatacatcaaaaaatccatgcaaatgaccaaatatcccattgtttgacaaaactaataatgcaacagaatgtattgacatagtccaccccttaacaaaactatcacaaacatccacactgaaagaaaacagacacaggtacacacttaatgaaaaaacccaagtatatttctggagaaagcagctacagcaaatatggaaacagatttagttcaataaacagctgaatgtgtatgctggtccacacatcctcaagcccattgaattttcctttggaattttcccttggtcacctttttttggattgaatttactttgtcatttgcccctggctctgtcacttctgtccagaggctgctgcagggatcctaaatgaacaaattcaatgatgcttattccttcagaggagtcaaaagagatgttgaatttaagaatgaaatgctcctgaaggtagatgagttcaagttgtcttgcattgtgttactacacttacaaaagtttgctatagagaaaggagaaaagcacatggtctgggtttctgaagactggcagtgaaagttggaggcttcctattttgtaaaatctgaccaaacatggaaataacaggaaaagatgtctgagtctggttcatagttgtctaaaatcatcagcatttataagttattaacacatcaatattaaaaattaatattaaattattaatttattaatactttattaatattaaattattattattaatatttaaaaaacttccaaataacatacaattttggaaggtaatgttttaaaaatattttctgtatgataacttttctgaaccatacacttatgaatatggaacttaaaattaatgctgcagtaaagtgaacgcaacaatgaatgtagggaaaatggattaaattagttcaatattctgcaggccgaaggcctttgatcaatattttgtctaattttctctttccagcatatatcacaaacataaaaaggaagaatattccacttttattgggggtcagcagggagggctaagaggatacaggagtgatggtatttgcataaaactggctggactatttagcttgttaatatctgtattgtgattgaaagtttattggaaaaatgtgctgatctcaaaactacactagttcggcaatgatagcaagagaatggaaccaacaaattctttcatctagaaggaaaatgaaaaccagaacttgaataatgggatgtatcttagatctggtactgaatgtggaaaattcaagaagtaatacattggtactactaatagtatcatgtaaggttttaaactttgtctaacaagatgtactcataatgataggtaatgcttcaaccccagtcatccctctgagtttcacaagatacagaatcagttaattcaacaagtatttattgagtgcttaccatgaaccaggtattgttctagctctgaagacatcaccattaaagaatagtaaaaaataaaaatcccttttgtcatggaacttgcattctagttggggaaagacagaaaacgcatacaaaataagtcaaatgtaaactgtcttagatggtggtaagtgttacgatgagttacaaagcaagaaagtgggtagaataacatcctgccccttaaaaaagcactagggaaggggttaatgaaaagatgatcttagcctacatacctgaagcgagccatacagatagtggcggaaagtaggttctaggttaggagaagagaggcgtagggcaaaaggaaaattattccctttttgcatgtccttctatacagtgtgaatttgctaggcctgaatatatttatttatttgttttcttgaggtctgagctgtggaataatgtgctaaatttgttttcttctctatacttgtttgtactaaaaaaaactctaattaatgcagcttacaataatgtgtactgaaacccagacacattgaggcatttaacttttctgggaaagctgtagctaccgtcagggtatgatttatgactataaaagtcaaatagttgagcctggggtaatcacccactgaatgtgattggttctttggcaattgtgtcctaaacaaaagcactctgtcttttatggtcagcattttgctaagctccaactaggttactccatatttactgataggagaattgtaatgagaaacaccagtaaaaaggagaggttgaccccagtagaaaaccaaaagcaggttcttgtggctttcccaggtgcagatttgaaaaagacagtattactgataaataattaggttattacaaagaccaatattttcttttgtcagaattttaatcattgaagtggtataaccacaatttgtatttttgcctgaaataggagtggaatttgctggtgttaacaaatgcaagaacaaaataatactatataagcttagttaactgtttttcaatagcctttagaagaattttctgtaatacacacacacttctttttttttgagatgctaaaagaaattttaataattgttacataacatactgtgtagctatttgatgaaatctacctctgtgtaataattattaaagtaagtcttgaaatgtatgataagaatatattagttttttgggtacaatttccatgaaaaaaataagaaaacaaataaataactaaaataagaaataggaggttttttatacatactgttgtcatcatacaaaattactctattaactaaatttacctgacattgtcaccgttaaaagcaaaatcaagacaaaactaattctcaaatttatttaattttagtaatatattttatttaaccctatatacccaaaatattttcattctaatatgtaatcaatatacaaaaattattaaagagatgttttatgttcttttttcatactaaggcttgaaaatccagggggtattttatttatttttatttagtgtactttaagttctagggtacatgtgcacaatgtgcaggtttgttacataggtatacatgtgccgtgttggtttgctgcacccatcaactcgtcatttacatttggtatttctcctaatgctatccctcccctagccccccaccccccgacaggcccctgtgtacacacacacttatttctaaaagaattaattttaattacacaagtttattatctttggataatcaaaaggtaaaacattacgtttatgtgtagagccctttttacgagccaccaccccaaatcctgattttcttcaaaaggtaaccactgtgatcactttgataggtattttacagacttttaaggaatttacatatgtatacacatatacacacaatacatgtatatgctcacactggtaggatagttatgtaagaagataaatggtatttatatgtctatatctgtaccttgctttatgccaacaacatgtcttggggattatttcccatgctggaattttaagacctacctctttcttttcacttactgcatagcagtccacaatatggttataccataattaattggcctcttatttggacatttagcttgttgcacacttctcaactacaagccatgcagcaatgaattctgtagtgcacttgtgcaagtgatcaggcagtggttctcacggtggcacccagaccagccgcatctgcatcgcctgagaacttgctagatgcaaattcttagccctaccctagacttattgactcataaactgaggatggggcccagcaatctgtagtttaacaagccctctggtgaatctgatgcattatacaatttgaaaaccactggcaggtatgtctgtttctacagacacacatgtacggatacagtcagttctataatgtaacatatgtgttcttaaacaccactgtgctatgcaaaagtatgtaataaaaggcctcggggcttttgagaaaaatgaggttggggcacaacagttaaaaacttcatcagtgacacgttaaaaacaaaagctgggagaccaataaaaatgatagtgcggttttatacatgttaaatgggtaaatacacaaacgctacagtaaatatggcaccttcccttgaaaagaccagaagtttgcttgtgtaagttggtattggaggggttgacccttgtgagtttttgggtagtggcggaaggagggttacatgaaattggaaggtaagttttaacagcagatgtggtgagtgtggctcctgccgcacgtggtgaactgaggcagttggtcatgttgaggtgtgtgtgtgtgtgcattttgggtattcctatatggctcagtccatttgggtgcatttttctgcttttccctagcatttcttgtggataagcaaatgcgaaattggagttatgtccaaattttcccccagtgtatcaatttccttggaataaatttgccttttcgatacaggtgtcacagctgtatgtatggatgcttattcttttgcgtacattacacaaaataactccatacactgtactgaatgctgtttttcacttaatatttcttagagctttttccatatcgccacatagttactcgtttttttttttaatggcatttaaagcattaagagatgactaaattgatctccaaaatgcttgcaacaacctacactcccatcaacatgcttcctacaccttggccaatattacctattatcacatttattaacttttgccaaccactagttaaacgtctctctccttcctctccctccctctcctccctctcctccctctccctctcttccctctgctccctctgctccctctgctccctctgctccctctcctccctctcctccctctcctccctctcctccctctctctctccctctccctctccctctcctccctctgtctcctcccccacctccacagagacatttacactgtgaggaatgcctcccgtaagtacactgatagaaaaaggaactttaaaagtgtgaaacaggtggcgaggtggtgttgaaatggtaaaaaaaaaaaaaaataaataaataaaaataaaaaggaaataaaatggatatgaaagaatacataaaaacctattaaaaaggcagaaaaaaggaattccctttctgcttatttttcacttctacctttgctaaatacaacttatccactttatgagataagatattgagttgaccctgtaggattccatctatcactctagctggttgacatctccaaaaatgcagcttacactattaatccattcacttcagcaaaacatgcctaagggcatcagattcttctgtttatcagtattgggttccttggccccaacaagctcagcagatacagctgaacagagtgatgtgtggtggcttcaactcttgagtctggggcttctaacggcaaaagtgacagacatagaggctcatgcaggtgtcagatgttttcctgtaaagaggttggcaatggacgtaaatgcttccagctgggcacattaccaggcaggataagccataatgatttaataatgaaatcacattggtttatgatcattgttcttattaggaaatatcattgctttttgatgatttattatgtgaaactgagttttcatataaacactgtgatttgcatttatttgtaatatatatttgcatatgtatatatatctgagtgagaatgacttactaaaagtaatcaccaaaaaaagaggatggaatattgatgtaaatatgccacaaatatttaaggaaatgtagaaattatgaagattattatgatgttgccacttcaaaataatattagatgcattttcctttatgtgaaactgacagagaactagtagctggatccatctctgttttgcaattaggcttttgcacctaatcacaaactacgatattattaataaaatataaagaatatatataagggttatatagaaccaccatttcccttctaaattaaggacttgctttcctgtcctcatttctcctcatgtgttctgacatggaggagagagagaaaaaaaaaagttaagaagagggaggaagaacattttgacttatgaaagagctttcagtctcatggggcctggaacagttgctctggagcagtgaaggacactacagaaggcttctctctctctttttggttatgattctttgctctatcagctgtgatgacttgtaagtacagttcctaggatcaacccagggtgcaaaatttagtggtgagttgcaagggcaaagcaaagcatgtctcccactcatctgcactcaatgtcaggtacataatttgggaagcccagtgcaaaataaaaatgtggggtctcttgttccaaaagcaggaaaaaatgccattgagggggctaaaatataaagccttgccctatctttcatgggctttctctttcaacttgtcatggtattgttttatttgctattcagtgctactataagaaaaattaaagacgtaagtcattagcctgagtgttacttttcatctcaatattgtgcaatgtcagttttaaatgcaaacataagagcatttaacttggatgtggaatcaccaaaattacatagtttgtattttgtagcttgtatgtgcgtatgtattttgttcttaccagcatggaggaaatgctgaacaaaactcaactgtttttattttacttcttaatacatgtacattctaccaatactctctacctttggtttactgatgaataaagaaggactaaaaggaaaagaatctataggttattgtataagtctgttctcacactgctaataaagacatacctgagactgggtaatttataaaggtaagaggtttaatggacttacagttccacatggctgaggaggcctcacaattatcgtggaagataaaagaggagcaaagtcatgttttacatggcggcaggcaagagagcttgtacaggggaactcccctttataaaaccattggatctcatgagacttattcactaccatgagaacagtatgggggaaaccgcgcccatgattcaattatctccacctggccccacccttgacacatggggactattacaattcaaggtgagatttgagtggggacacagccaaaccatataattcaccctttctctgtccttttctgtcatcgttttcagtgtaggtgtttggccaatacagggaagtaacaggtataagaaaggttatgacaggattccttggtcattcatgtttcttagaatgccactaccttcttttggtggttgaagcaaattctggtttgaatggaaagtatggcctcttagggctatcagagcttactcagttctagatgtatcgtatttaccttgtatttgtttggcatctcgctgaactcccatgcactatgggcctgatggagtcctgtgctcctggggcattgtgaatgctgtgtgtaaatggggctcctaggaacaacagacacatattgtgcacattttctctgctcacacacacatgttccattgtcccctcatgctccactcaaaaaatacaagttcaaagataaaaatcattaagaatttcaagatagtggcaggagaagattaaactaagtgcaggacccttctctctgtggggcctgtgtgactacacaggttgcacacccacgaagccggccctttctatatcaggcaaagctgctggacagcctgaagcctcatgagcatgccatgtatgaaggagcccagcttacagcaggctggatattgccaatagtgtaccagtgcaaaatggtttccctgaaacctttaatacacttacttatttcaaactcagttgaattgatatcattgagacagctagatctcttagagggctcccagtgccaggaggagtgcctttcagatgggtctttgaaacctcagtgttatagctagaaccaggtactcatcattgaatcaatctctctatatctcttaacattttttccttctcataggatttccagcaggagagctccagaagcctttcttttggggaacagaatatcctcggtgagtaaatgagtacagaaaccagttactgaccaattaggaagaacatgttgctttggtagaggacagaagaaacaaagtcaaaggttattcagcagaaagaagccatggaatctggcgtgggtcgcctgtactcttatcattttaggtatttgttttctgatccttgttaccagggtgtatggctggacaggaaagccatcttacacataggtggctttcatttttatgcatttattctcttacccattaactcatactaccagtatttggacattgaaggattgttgggatttgaattgatgggatgagtctaaaaccattccaggtagaagaaacagtgtgagataaggagggaaaagtgcttctataatggcagagtgtagtttggctagcccaaatggtatatgaaaggaagtagtggaaaagaagattgaggtttgatattggagggctctgcatggcaaataaggagcttggatactaataggcaatagaaaatattgaactttttgagcaagttagtaagataatcgaatttatctttagaaatataacctgtgtagctacagaataagtcaaaattggtagtgtatggacttagggataccagtttaaaggtcattttaataccaacagattgtagactcatgtaattcagaatttccatacatagtagagattctgataatatttgatgtcaataatatcaccatttctattatatactttttacttttgtgttttaatgcttggaaaattttagtcttgattctatacattgagtctcttgtgttttggtttggatatatgacaatttaaaaatatgtaggtttaaaagatacagattcccataaatatatcaataagagaaatatgttggcaatgttttcatttggcctttgggctttcccggtagcagaccttgtggtaagtattcaagtgcaattagttctttcgggaggtggtacaaggaaacaccagtaggggagtggagaattgagacagtgagggaaataagccaaatgaattatgtcctgtgagtcttttatggctgccaaaatgaattactacaaacttagtggcttaaaatgacataaacttataagcttatagttctgtaggtcagaagtccaaactggttctcactgggctaaaatcaagttgtcagcagggctactttcctttctggaagctctagagatgaatctgttttcttgccttttctagtttctagagggggcccacattccttggcttatgacctcttcctccatctttaaagttccatagtcacatctccttctgactctcatcttctgtctctcccttctacttataaggacccttgtgattacactggtaccattcagataattcaggataatcttcctgttttaagttcaactgattagcaaccttaattccgtctgcagcccctttactgtgtaacataacatattcacaggttccaaagattagcaatatggacatcttttgtaggccattattccacctaccacatgtgtgttacaaagccagttatcaccatgggcaactggagctcagtcttgctggggaactgtaaaacatgcttcagagtgatcccatctcagggacatgggagctggggtatttatctgtcctccaactcaccttccatcattgattgagggctcctaccaggggtacctggcagtgcccatcctaggccaagagggctctagtggctggagaaagtcttcaggcaactagtttcaggtgctgacatttgaaggctgtcagattggtgtgctcaaaaatagtgagggctacgaggacgtgggcagccatcgataaagcttactacagggaagcaccatcgttagagtaaataaaaattgcaggttcttatttaaccaaatccattaataatatcccaggcctcagctccatagttttctttggtgttcagatgtttggactcaatttgccctgcttttaagtttagaaatatatatatatctaaaaaattaaaggtttaggataaatattctttaagctcccttcaaactaaaaaagtcctataattctttgattctgcttactgttaacaatttaactgagcttctattattgtggttatatagctggagactaggaaatagtctggttggatttctgaagttattgatgaagtaatttgtttattgggtctgtgagcatgttagtgtctatttgtttgtaccttaggctaggtcatagttaatacttgagtgtgaaagagagtttttttttcctaaagacttgtttgtcctcatccacttaatgaatagctactacatatcatttgggtactcagcattgggaatatgaagatgctaaagacatgggagtcatggtccagtgagatggcttcccatatgttcatctagtctgtattaataaatggatagcctccagaatcaagggagtgggtatcctttctgctcacagtggtcagcttagtcctcacctgagtgttgagtctaattatggggcatgaacaagctgaattgtttccagaagagagaatcaggactgtaaatggttgaagacaacgtttcccaaagtgtgtgttccatgaaatagtaatagaggtaagacatcctcccctcccttcagttttggggaatcataataattatcaccataaaaatttcctagaagctctccaagaaagaaacctatttagatgtgtttaacacaactaccttttttgtacccattaaccatccccacttctgaccccagccccccaccacccttcccaggctctggtaaccatccttcgaaatgcagaggttcccaaactccccggtgttttgggaaatgctgatctagaattcatgactgaagaataagagttgaaagaacttaataacacttgaagtggaacctcataactgtctgcatatttttgaaggaaagttaaggtggtagaacgacttattatattcaggagattcagcaagtgttcagttagaggctacactagaccaatagatgggagccatagaaaagacatttcagatcagcattatggagagctattacgtttagacccgcccaaagaggaaatgggttaccttagaaggggatgagctcttggtcattggaaatacccaagcagggtattataaccatttgaatgggtttttctagagggggcccattcctctagtaggaagttggagtagatgacctctaagccatttccaactcagaaatttttatgaatttatgattcaggcataggacagcccttacttgataacagtgtgagatcatgattaagctagacagcagtatagttgttttgttgttgacagcaaatccggtgcatatgttaaacccactgagtaattagaacaaaagagaaactgagtaggtagtaaaagtggtgtcttctccattttatttttggaagactagatcttcagtgcaagaaatcttccagtttctggccagccagtcaaggttgcattttaaaagggcgagtttatttttttatgcttatttatttatttatttatttatttatttatttatttatttatgagacagagttttgctcttgttgcccaggctggagtgcaaaggcatgatctcagctcactgcaacctccgcctcccgggttcaagtgattttcctccctcagtctcccaagtagctgggattacaggcatgcgccaccatgcctggctaattttgtattttttaatagacatggggtttctccatgttggtcaggctggtctcgaactcccgaccccaggtaatccacccgcctcggcctcccaaagtgctgggattacaggcgtgagccaccacgcctggccaatgacatgctaatttaaatactcttcattgataaaatagaggacatgaatctaatattatgaaatattattattgtcaggcttagtcatataaaattactttttctttgtctcttgtccaaaggattgtgattaagtaactgagaattgaaacttaaaatgattcaatcattttctgaattctctattgccttttgcaaataggaagcttgttggagcagccctgcttaaaggacatttattgcacagcaatttctataagctcccattgttcatgccttcaattcatccagtcaacagcattgactgagggatgtagaggaccaagtacttattctcagagctgagagacctggaaaaactaaatgttgcaatctgcacactgatagctactgccgcaaaaattaacactatgtaaaattacaaatttgtcccacactgctatgatagctctatgattgaaatgaataatttcactcttacttctttaatgaaggtttgcaatgatggaaaaacagtaggaagcattttttcaaatgcaaattaccttacaggaaagaaataacaaaggaaagcattgccaccaaggggaaaaattaaatcttacaccacttccttgggtgtagttgagacaaacagttagcatggtaaggatcatttatgtcctgtaataacatattactttaaaaatttccattccttccagttatgggtcctatctatttgctgggtgactttgatgttgcatgtcaggaactaactgtgagatatttttagcataattgcaaatctcatgaagaatcttcacaataaggattctaagtggtgtgtaattctcatccacaggttgaatgactaaattaagatacatacagatctgtcacttgcatgagatggtaaagttaactaatcagttaaatcattgttactttcttacgctgtacaaggcatagaggatgtagcaatgaacaagtagataagagagtggcctcaatagaacttacatttgagagagaaaatcccagacatacatatggaaaccccattattgatttcttcatatattcttaatatgctttgctatgtaacaaagcaccaccaagcaaccatttattagctcatgattctgtaatttgggcaggactgagctgagacagctgctctgtatggtgctggccggggtcgctcaactagggctggactcacagacaggtgagtgaaggcgacctcactcacctgtctgtgccccagttgggctggctctcgtggctggggcatggcagggcctctctctcttcctttggagtctctcaacttctggggtttctcgcttcttcatttggcctcattccctctagctgtgtagttgaacttctttgcaagtgacttccaagaaggtggaaaatggaagctactaagtttcttaaggcctagacccagaagtcatacctgaccccttccactgcattctgttggtcatagcaagtcccaaggccagtccaaatttaagaagagggaaatagattgtctcttgatgggaggaggggctatgtgcattcaggggtagggagaattgttggtgtccccttttatagataatctaccacatgcttcttcagaggtgaagagaaataatgtggcacctttttcaaatctttgctattcagttgctatcttgtctacaacagaaagaggaacgtgactacctttgaaaatagagtgatcccttttaatctctactctattcctttttttatgactacatttggaaaacaatttaacttctaagactatagtgacttttcaacaagtttccagataaaatatacatgatatatttactgacaggatcttttcaagccctgttctaggtgttcataaatatatagctatagcagataaaaaaatcatagcaatcttaaggctgaaagggactttagaaatcatctctttcacatccctaatttcagagagtagggcactaaggttcatatgtggtaataatgacaatgtttgttagaatttatattttctttgtctatttcaattggaaggtatgtttagattttttacagctttatgggtatggttattcgattgttattaccatggttactagaaagcagtttatcttggctttccattgaaaaaattaaaggattatgctctgagattcatgcttgtaattgtctccaaattatgtattaatgccatagatctctgagttatggtgctataggagtaattgtcggacatgaatttacacatggatttgataataatggtaagtaccggttcattttataagctgctgcttttataataatgttgactatatggatgttaattgttatgattatctttgcatagcagcagcatcatagcttgaagattatccaaagcaatatgattgctgattgaaaacttttcaccgtgtcttgctgtgatggcttgcaataagtaaacaattgttcccattggtgatcggggtagactttaaaaggcagccttgtaatttcaataaaattagctttgcatttagatcaggattgctgtagctgccacaatagttacagagattgatttatagcttctccctttgtcatttattcattgtcttgagatattctccctggaggagcaagctctgctccaacgatgattatacatgctgccaagttaggactcgttgagttaggactctggagcttggctgactggttcccttttacgatttcgaagattatgcaatgcttaatctatatttttctctatactggcttatattctgattattattattattattatcattattgagacggagtctagctctgtcgccaggctggagtgcagtggcacgatctcggctcactgcaacctcggcctcccgtgttcaagtgattctcctgcctcagcctcccgagtagctgggattacgggcacgtgccactatgcccagctaatttttgtatttttaatagagacggggtttcaccacattagccaggatggtctcgatctcctgacctcgtgatctgcccacctcagcttcccaaagtgctgggattacaggcatgagctaccgcgcctggcctattctgattattttaaagtctatactttcctgataatttatataataggatatgctttgtatcccgatgacatttaagcaaaaagaaaaagcagaatatgacataaactaaagaaatggcttcctttgagagtcctcatcatcattaatcagcactcttttctcctttaactttggagtattatcggaaggccacatgaaatctctgaaacttacggattagtagcaaattactatcacatccatacccacacagtgatttacaggcagtctcaggaaccagctgccctaaggcaacgttatatagaaggggacctctttcttccatccctgtagtatctccaacatccttcctggatgcctaccccagggccagagacacttaggctcttctagaaaagtcttcctgtactcccaccagcccttccttaatcacctagattttttgctcccctggtcttcccttctctgttaaaatgtggctgacttgtagttataaatgtggctgacttgtagttatctgactctgcagagctagactttctgcctttgggtgtttggtttatctgagatgagagtcttagctaagaaaaaaaaaagctaatagtcctttcttcgttctggacctctcttgataggaaatttaagtacagttcctccccagaaccttctggagtctttctcaaaggactgaatctaatggtggcaatttcactctgtaaccaatgcttagaacagtgcattgcacatataagtacatgcccggtacctatttaatgattggttggttagtgggtagaggacagtgactccatactatcccagggggtggtgttagtagtatgtagccttgctgaagagttttggattgttccaattaacaactttacttacgggacttttttgtaagctctctgtataattaaatttaaacgatgcctctgattctcatagtaaccctgaatatagaagacagtctagcagcatccaaattttgtttcaaaggctgtagagaaaatgaagagtgagcacatagcaagaaagcatgtgtaatctttcttcccattgtgttttggagattttcattcttattccaagttttctttttagagcaatcttccctgtctaagcaggacagatgggccttccgtccacactagtggctgtggaatgaatcataacagaggttttatgtgtctttcagctcctggcaacttggaggaaacaggttcctatagggctgagtcagggtctatgatcgcacagtatggatgactcactggggctattcctatggatcatttggaatttcactggtagtaatgctctgattgcctccatgggctttctgaatgaagccattttatttcataatccagtgaacactttgggtcaaatcaggtgaagacacagaatccaagattgaataagactagtatatgtaataaattgatgaatctcatttttaaggtgctctttgttccttagaaggaaagaacttcctcaattgtctttatcctttttgccctttttacaattaacctgtgacattggagagaatgcaggagctgatctcaggaagagtgttccctgctgttatgactgctttttgaaggcttgtcgaggtgagggaaaggaaagatgaatttagtttccataaataacacaaatgtcttcgaacttttccttttgctaggtagaaaatatgataaaaatggaaacctggatccttggtggtctactgaatcagaagaaaagtttaaggaaaaaacaaaatgcatgattaaccagtatagcaactattattggaagaaagctggcttaaatgtgagtacaactgtggctaaggggggcaccttgtggttcatttttcctcatttggacattagcttgctttaaaccattggttctcaaagcgtgtttacaagatcaacagcatctgtcttccttgggaacattcttgagtcctaccccatacctgctgaatcagaatctttggggttggggcctggtcatcccttaaccaggcatgaactttttcctgatatattactagggctggaaaaatacctaaatccttgctatgcctcaaatctattatacttgtagatgaatttaggtaaaaatccatgtgcttcttttaaagggaatgtttataaacactgacttggttctcctggttcttaaaccatgctcagcccaagtgagaccactgctcattcaggcagagaaaccagagtctgtatccttgaatggtgtctagctcttttatcagtgtcctggacagccatttctctgcctatatatttttaaatatctacaactgtgacatgagaagacctaaaatgggtgcttctatgtatctctatatagtgcaggggttttcacactgtgaaaattcatctggagtatatgttgcttcaagaaaagcatagcagaaaggggttctagagtcagacatgggtccaaatctaggttcaactagttttatgaacttgggcaagttacttaatgttcctgagtctcagcatcttcatctgtgaaacgggtcaatgtttctgaactcatggatttgttgtaagaattaagtgagcaaagcaatgtggagcactagcacaaggcctgacataaagcaagtgctcaataaaagatcgttagttaatattcctgatccttcgtgacatactcattagtaccctatcccaggaaaaaacaaagccaaagatttttgggttaaaaaccccccaaaaaacaatagaacagctttcttggaggaagggaatttatatttcctgatgattagtatatacaggcatgaagatgaaacttttcacttaattgaaacaaatgtatccccatactagtcctgagaggtatagattattactaagtgtacaggttttacgtatgaggttcaaaggaattaaactgaggttcaaagagattaaaatccacggtagagtctagattagagtttaagtaagtctgtacgactccaaagtccatactgcttcccctatatcatgctgaggttcttattttaagttcattttatatctgggtgatgtgtgggtggactgctcttcaccattcattttggccaaagtgtcagagattgaaacttaattctgacaaatgtgtacctttgtcacaaggacgatagaaagggcatgcctgtcttagcaccaatccacttaaccatcagaaaacagcttcagtttcattcccacaggagagtgggtggcttcctttgtggatataagggccatgctttattatttttctggcttcatttataggagccgttcctttgtgcctgaatcttgctttgtagtgacttcgggggagctcagatggggcactacagatgcagactgtcagcagctgttgagtctttttttgttgttgttccttttcgtagctgttgagtcttgggagtccaaacctagggccacgtggtctactgaggcagaccagagttcaaggagccagaggggtgaggctgctccaaaaggctctaaattagatataaagcttagagtgaatggctgggcatggtgactcatgcctgtattctaaacactttggaaggccaaggtgggaggatcacttgaacctaggattttgataccagcctgggaaacatacggagaccctgtctctacagaaaattttttaaaaaattagccgggtgtagtggtgcatgcctgtagtcccagctactcaggaggctgaggtggaagaattgttggaaccctatagtgagatatgatcacaccactgcactccagtgtgggtgaaagagagagaccctgtctcaaaacacacaaacacacacgaaaccctcagagtaaaaaggaaggagattaaattttttaagcaggagtggatataatcataatcttcaagagccaagaggagttgggacttgagaaagtagcatattaggaagcaaaggctctggagacagaagactgcttgggttcgaatcccagtgacatgcgagcagtttacttcatcactctgtcttaggttcactagaagcagagcccaagaaggggttccttaggtcattgacttttttgagacagcgtctcgctgagtcacccaggctggagtgcggtggtgtgatctcggctcactacaacctctgcctccctggttcaagtgattctcctgcctcagcctccccagtagctgcgattacaggtgccagccaccacgcctggctgatttttgtatttttaatagatacggggtttcttcatgttggccagtctggtctcaaacccctgacctcaggcaatctgcccgccccagcctcccgaagtgctgggattacaggtgtgagccaccgcacccagcccaggtcagtgatttattcagaaagtcgtttcaggaaaaacctataatggaatgagggaaacctattggtttcaggaaatgtttagcctcaccctgattccacagaggattctggagcacgaactgcaccacagaaattgttcagcccaggtactgggttgttcaaactgcacatcagtcaattactggaaggtgggttataacctcccagcggtctccagatgaggtgactcccataagctaaggttgatctgagctgttagcagttgtgggaatgggtgcacagtttaggcagaaaaggggatctggtgggatatcgacatctgctacactctcggagctttagatcctcatttgttgagcaagggtggtggtaattagcacttacttacctcatacgactgtggataacaaagaatatacgtaaagcaggaatggtagcttttgtgtactgaagctaggagggtcctgagtgattacagtgaataatattttccaaagatttgtttttattcattgatattgcttgatacctgggtgactgggctagcttaaaagtaaagtgttggtaagatccatggcttgaaagttaaaagcaaggtatattagttttctgttgcttgctataacaagttactataaacttagtagcttcaaataacataaattatcatacagcgctgtatgatttattatcatacagctctgtatgtcagaagtctgacatggatctcagtggactaaaatcaaagtgtcagcagggccacattcctttgtagaggttctaggggagtatctgtttcctcgccttttctagcttttagaggctgcccacattccttagctcatggccccttcgtttttcaaagccagcactggccggtggagtcttctcatgttgcatcactctgacactcgctctcctgcctcccttttcctcttgtaagaacttttgtaattacactgggtccacctggacaatccaggataaagtctgcatctcaggatccttaatcacatcataaaagtctcctttgccatgctttatttttccagcttcattttgtggggaccattcctctgtgcctgaatctttctttcttcgcagtgaataaggtaacatattcacagattccagggatcaggacgcagacatctttgggaggccgttatcctgcgtgttatacaagagttgaatgacttttctgtaaagggccagatagtaaagaattgaggctttgtggggcgtatggtctctgttacaatatttaattctgccactgtagcaagagagcaaatacagactatatgcatgggcatggctgtgtcccaataaaacttgatttatgaacaccaaaatttgaatttcatataagtaattttcatgtgccaccacaatattattcttcttttgatttttccccagttgttgaagtatgtaacatccagtcttaccttgaagcctgtacaaaaacaagcagcaggttggatttggcgtgtgggctgtattagtttagaatatttgtgtcctagctcatttaaagttttgagaaacaatcttgaatattgggaataattttttttaccatgctggctggttgtcatacatatcgcagacctcgaccttgtgatctgcactacttctgtttgatttttcttccctaggagaaccactttccttttaattttccatggaaattgctgaaggtaaaatgatgatagttggtcttgaaatcttgttcctgtgtggatggtaaatttttggaaacacaggcacaatgagaagaatactcaaattatgtgagttaatcagagaaagtaacctgtgtattgacattcctgttttttcccattaaaccagagtcactcagaatattgttaacattttattggagctggctagattggttagaatgaagaggtaggtgaaaaagaagtgtgtagcataatgaaatagaaagtattacattccagagcaccttgctgaggatagtttgccatctttcttacaatatattatgcctacctctgatttattgaatgtgattttctctttaaaatatgatacttttcttgctataatattgatgcctcttgctgaatgatagttgaccgtgaaacacgcattcattttttttttttccttttttctttctgttaggtcaaggggaagaggaccctgggagaaaatattgctgataatggaggcctgcgggaagcttttagggtatgcgctgctacatttaccgtggttctaaaaatcaagccataaaacaccatatgggggtacctcaattcataccatagccatgttcttgaggagttagttagttagatattatggaatttctgtaaatagaagtgtgtctccccattgaccctattacataaagagaactatatttcttttttctttttggggtgtgaagtcaccctaaagaataatatttgttattaagaatcatgtatttaaagaatagcttttagaaaatacattcaccatcagatcgaagcatgctacagcaatctccttggggctaggttcatttgttttccttgagtacaggtctttctgtagtcctcctataaatttctcttaaaatatcaaacttctaaattatgaccagagggtagtggttctcatatactgggccaagtgatagttcataataacgttttcatcatccactagtttgtggtcaaataagaagcataaagataatacagaaagatttcataaagctaaatgcattaaatttaatgactagactgttattcctggttatatccttcctatattctagttgaaatatactttattttataaaatgagggcactagaagatgataggttttctcttacgtgtcaaaatgaaaaaaggtaatatgcggaccccaaaatgtattgccataggggccttgccattgtgttagatttgtttgtcccctgctaggaatggaaagaacagctttttttctccaagagttatttaacatctgaatgctttggtccagctgctttggtatacattgagcataaggcctttttgcaggtgtacctgcctcactggtaagcaacaggacatggacttgtgtttcttaagaaaattttgacatgatgcattttgcacgtggcaggagtatatatttgctattcctgtgctagctgagcaaagagaaaaacccaccgttgcagagactcatctcttcttcttctctcaccaggcttacaggaaatggataaatgacagaaggcagggacttgaggagcctcttctaccaggcatcacattcaccaacaaccagctcttcttcctgagttatgctcatgtgagtagactgaggaaggggcatcagggatgagatgcaggacttgagtttgctcccttgatcaaagaaagatttcaaacaaaagtttaatggcatgactttgattttcagcaaaaatgttatcttgattattttcagggtaaatctcatcttcttaatgttctgtagtacataattaattaactgattgaatcaaggtttattagtattttttaaatcaaatgggttagcagccctgtggtaattcatttgatagttcctcaatgtatcttgacttcttaatgtgtttgatactatttatttgtaaccatttctagtaacttgctctttggctttcatgggcctgctctttcctatattgctcctcctttgcctcatttgctgactttatgccaccactctcagcctgtgggggaccctcagggtcatgttcccaactgtctaatgcatatgcagagacccctagagctgaaaaagaacaaaggcaaggagagtcatgtcactcttttgtgagtttaataggctcttggagcagaaattgaaaggaagatgtacacgaaataaagcacagttccgagcctgagtctctgtctaatgaggcaagtgccaaatctttattagctattatactggtttatgtcataaacatacgggcagccttttcaaagaagtcagggataggtcaataaaggttctagtgaatggcctcaccgtgggcaaatgtgtatgaatatgctcaaagctagacaaaaattttcatcagtacaaccttttgttcctaagtctgtctttgctttcactgctaagtaagctcattctcacacgagtcttctataattcactctggtcacaggattcttgcttgcctgcggtcttttatttcttaaagctaataaaaaacactaaataaattattatttagcaacctaatgtcaacaaaactcaactctagtcatccacaacatgactttccttttacttttcctgtttctatcatcacatcccatctttagattttcctggttagaaagcctggattcttaggtcttatttgatgcatctgtcctcaattttacaacatgtattccagaagccagatgtttcatactttactttactttaaaaaaaaattatactttaagttctggggtacacgtgcagaacgtgcagttttgttacataggtatacatgtgccatggtagtttgctgcacccatcaacccgtcacctacattaggtatttttcctaatgctatagctcttctagcccccaaccaaccctctgacaggccctggtgtgtgatgttcccctctctgtgtctatgtgttttcattgttcgactcccactcatgagtgagaacatgcggggtttggttttctgttcttgtgatagtttgctgagaatgacggtttccagattcatccatgtccctgcaaagaacatgagctcatccttttttatggctacacagtatgccatggtgtatatgtgccacattttctttatccagtctagtctatcactgatggacatttgggttggtgccaagtctttgccattgtgaatagtgccacaataaacataagtgtgcatggcatctttctttatagtagcatggtttataatcctttgggtatatacccagtaatgggatggctgggtcaaatggcatttctggttctagatccttgaggaatcgccacactgtcttccacaatggttgaactaatttacactcccaccaacagtgtaaaagtgctcctatttctctacatcctctacagcatctgttgtttcctgactttttaatgatcaccattctaacaggcatgagatggtatctcatagtggttttgatttgcatttctctaatgaccagtgatgataatgagcatttttcatatgtttgttggctgcataaatgtcttcttttgagaaatgtctgttcgtagcctttgcccactttttgatgaggttgtttttttcttgtaaatttgtataagttctttgtagattctcgatactagccctttgtcaaatggatagattgcaaaaattttctcccattctttaggatgcctcttcactctggtggtagtttctttggctgtgcagaagctctttagtttaattagattccatttgtcaattttggcttttgttgccattgcttttggtgttttggacatgaagtctttgcccatgcctatgttctgaatggtattgcccaggttttcttctaggatttttatggctttaggtcttaagtttgtttaagtctttaatctatcttgagttaatttttgtataaggtgtaaggaagggatccagtttgttttctgcatatggctagccagttttcccaacatcatttattaaatagggaatcctttccccattgcttgtttttggcaggtttgtcaaagatcagatggttgtagatgtgtggtgttatttctgagggctctgttctgttccattggtctatatatctgttttggtaccagcaccatgctgttttggatactgcagtcttgtagtaaagtttaaagtcaggtagtgtgatgcctccagctttgttctttttgcttaggattgttttggctatatgggctctttttttttttttttttttttttttttttttttggttccatatgaagtttaaagtagttttttccattctgtgaagaaagaaagtcaatggtagcttgatggggatagcaatgaatctctctctaaattactttgggcagtatggccattttcacgatattgattcttcctatccatgagcatggaatgtttttccattggtttgtgttctctcttatttccttgagcagtggtttgtagttatccttgaagaggtcctttacatcccttgtaagttgtattcctaggtggtttattctcttagtggcaattgtgaatgggagttgactcatgatttggctctctgtttgtctgtgattggtgtataggaatgcttgtgatttttgcccatcgattttgtatcctgagactttgccgaagctgcttatcagcttaaggagattttgggctgagacgatggggttttcttaatatacaatcatgtcatctgcaaacagagacagtttgacttcctcttttcctatttcaataccctttatttctttctcttgcctgactgccctggccagaacttccaatactatgttgaataggagtggtgagagagggcatccttgtctggtgctggtttccaaagggaatgcttccagtttttgcccattcagtatgatattagctgtgggtttgtcataaatagctcttccaattttgagatacgtgccatcaatacctagtttactgagagtttttagcatcaaggggtgttgaattttgtcaaaggccttttctgcatctattgagataatcatgtggtttttgtcattggttctgtttatgtttattgatttgcatatgttaaaacagccttgcatcccatgtatgaagccgacttgatcatgtgatggataagctttttgatgtgctgctggatttggtttgcaagtattttatcgggtattttcgcatagatgttcatcagggatattggcctgaaagttttctttttttttgttgtgtctctgccaggttttggtatcaggatcatgctggcctcataaaatgagttagggaggattccctcttcttctgtggtttggaatagcttcagaaggaatggtaccagctcctctttgtacctctggtagaattcggctgtgaatctgtctggtcctcaactttttttggttggtaggctatcaattgctgcctcaatttcagaacttgttattggtctattcagggattcaacttctacctggtttagtcttgggagggtgtatgcgtccaggaatttatccatttcttctagattttctagtttatttgcatagaggtgtttatagtattctctgatggtagtttgaatttctgtgggattcttggtgatatcccctttatcattttttattgcgactatttgattcttctctcccttattagtctttcttgctagtggtctatctgtgttgttgatcttttcaaaaaaccagctcctggattcattgattttttgaagggttttttgtgtctctatctccttcagttctgctctgatgttagttatttcctgttttctgctagcttttgaatttgtttgctcttgcttctctggttcttttcattgtgatgttagggtgtcaattttagatctttcctgctttctcttgtgtgcatttagtgctataaatttctctctacacactgatttaaatgtgtcccagagattctggtacattgtgtctttgttctcactggtttcaaagaacatctttatttctgccttcattttgttatgtacccagtagtcattcaggagcaggttgttcagtttccatgtagctgtgtggttttgagtgagtttcttaatcctgagttctaatttgattgcactgaggtctgagagactgtttgttatgattttctttctttcttttgcatttgctgagaagtgttttacttccaattatgtgatcaattttacaataagagcgatgaggtgctgagaatatatattctattgatttggggtggagagttctgtagatgcctattaggtccacttggtccagagctgagttcaagttctggatatccttgttaattaattttctgtccatttatctaatattgacagtggggcgtaaagtctcccacgattattgtgtcggagtctaagtctctttgtaggtctctaaggacttgcttgatgaatctgggtgttcctgtatagggtgcatatatatttaggatagttagctcttcttgttgcattgacccctttacgattatgtaatgctcttctttgtctcttttgatctttgttcatttaaagtctgttttatcagagattaggattgccacttctgcttttttttttttttttttttttttttttttgctttccatttgcttggtaaatattcctccatccctttatttattttgagcctatgtgtgtctttctttgcatgtgagatgggtttcctgaatacagcacattgatagttcttgactctatccaatttgccagtctgtgtcttttaattggggcatttagcccatttacatttaaggttaatattgttacgtgtgaatttgatcccgtcattatgctgctacctggatattttacccattagttgatgcagtttcttcatagtgttgatggtctttctttacaatttggtgtttttcagtggctggtgccagttgttcctttctgtgttcagtgcttctttgaggagctcttgtaaggaaggcctggtggtgacaaaatctctcagcctttgcttgtctgtaaaggattttatttctcctttgcttatgaagcttagtttggctggatatgaaattgtgggttgaaaattcttttcttttctttgagattgttgaatattggccctcactctctcctggcttgtagagtttgtgctgagagagatccactgtttgttagcctgatgggcatccctttgtgggtaacccgacctttctctctggctccccttaactttttttcctccatttcaaccttggtgaatctgacgattatgtgtcttggggttgctcttctcgaggagtatcttagtggtgttttctgtatttcctgaatttgactgtgggcctgtcttgctagggaggggaagttctcctggataatatcctgaagagtgttttccaacttggttccattctccccgtcactttcaggtacaccaatcaaacgtagatttggtcttttcacatagtcccatatttcttggaggctttgttcatttcatttcactccttcttctctaatcttgtcttctcgctttatttcactgagttgatcttcaatctctgatatcctttcttccgcttgatcaattcggctattgatacttgtgtatgcttcacaaagttctcatgctgtgttttttagctccatcaggtcatttgtgttctcctctaaactggttattctagctagcaattcatctaacctgttttcaaggttcttagcttccttgcattgggttagaacaatgctcctttagctcggagaagtttgttatcacccaccttctgaagcctacttctgtcaattcgtcaaaatcattctccgtccagttttgttcccttgctggcgaggtgttgtgatcctttggaggagaggaggtattttggtttttgtaacttttagcctctttgtgctggtttctccccatctttgtggatttatctacctttggtctttgatgttggtgaccttcggatggggtattttagtagacgtgctgttcctttctgtttgtttgttagttttccttcttacaaacaggctcctctgctgcaggtctgctggaggtgcactccagactctgtttacctgggtatcaccagcagaggctgcagaacagcaaaaattgctgcctgttcttccctccggaagctttgccccagaggggcacctgccagatgccagccagagctctcctgtatgagatgtttgtcggcccctaccgggaggtgtctcccagtcaggatacacgggggtcaggtacccacttgaggaggcagtctgacccttagcagagctcgaccactgcgctggctgtcaggcagggacgtttaagtctgctgaagctgtgcccacagctgccccttcccccaagtgctctgtcctagggagatgggagttttatctataattccctgactggggctgttgccttttttttttagagatgccctgcccagagaggtgacatctggcagtctggccacagtggccgtgctgagctgtggtgggctcctcccagttcaaacttcctggtggctttgtttacactgtgagggtaaaaccacctactgaagcctcagcattggggaacgccccttccccccccaagctcaagtgtcccaggtcaatctcagactgctgctgtactggcagcgagaatttcaagccagtggatcttagcttgctgggctctgtgggggtaggacccgccaagccagaccacttggctccctggctttagaaccccttctgacgggagtgaacggttctgtcttgctggcgttcccagcaccagtggggtatcaaaaaaaaaaaaaaccacacacacacacacagaaaaacaacaacaatgaaacaacaaaaaactcttgcagctagttgggtgtctgcccaaatggccacccagttttgtgctggaaacccagagccctggtggggtaggcactggagggaatctggaatctcctcctgttctgcaggttgcgaagaccgtggggaaagtgcagtatctggactggagtgcacggttcctcaggctcagtccctcatggcttcccttgggtaggggagaaaattccccgaccccttgcacttcctgggtgaggtgacaccagaccctgcttcggcttgccctctgtggcctgcacccactgtccaaccagtcccaatgagatgaactgggtacctcagttggaaatgcagaaatcacccacttactttctgcattgatttggcattgatttcgctgggagctgcagtccagtgctgttcctatttggccatcttctagttcttctcgatgtttcatacttttaagtgcttttcagatttgacatcttctctcctgttttagacagtttgggctgctataacaaagtgtcatagactaggtggcttatgaacaacagaaatttatcacagttctggaggctggaagtctgcgatcagagtgctagtgggatcgagttttggtgagggctttcttctgggttgcacactgccaatttctctctgtgtcctcacatggtggaaagagctagctagctctctggcctcttcttataagggtactaatcccattcctgagggctccaccctcatgatttaattgcctcccaaaggcccaactcctaatgccatcacattgatcagggcttcaacataagaattttgggggatagaaacatttagtccatagcatccccattaccctatcttatcatatatagttagttatcatatataggcataatcttaataaatatcctctactctggattatcccaacagccttatggaatgttaatctgacttcagcatttttttttttaaccactgttatacataccattggaataccacttttatttcattaccaacctgctgaaagaactacagtggctcccaaatgcctaccacattgaagccaaatacctccatctggcttcccaaattttcagtatgatccaactccactcaatccaattcaatttcccataactaactccactgggtgagaaaaaactcagccttagtggggcaagtatcctcacttctaccctacaatgtcatgcccattactgtctctttggctttgcttctgattctccttctataatgcaacccttcctactcttccccttcagatgattattcaatctaagcttcatccttcaggatccatgttgagttccactccctccacatcttccataaactcttccccaaggaccccagtccttattattttcttttatcttcaactccttttatctttcttactttcattaccatgcagttgagtacttaactgctctccaaatgttcaagaattttagttttatctccacagctaatcttctggatccttacacttcctatctccatagcacccagcaaagatgctgggtatattgaagacagttgatatttttagatcaattgcttgaaatgactaaaactaacagttcaactaaggagactcccttttactgggtcagatatataaaataagtatacaaaaatagaactttctagagttgggattggcaaactagggccaaatatggcctgctgcctgtttttgtaaataatgttttattggaaagcagccacattccttcatttattcatgatctgtagctggttttgtactacagtggcagagttgaataattgaaacagggaccttatagtcttcaaagcctaaaatctttaccatctgtctcttttcagaaaaagtttgctaacccctgctctagaggacaaagtatagtgatctatcaatcagttcttactatttacatcctagcccacaatatctctttgtagataaaataaactaattgattgatagtgaagttacttataattctgaaatgtttccagatataataccaaactaaactatagctgactgatttattgtaaactaaagagatagatagatagatttaggggggaaaagtggaaagctattttatatcttatatcactagtgagaaatttatcttggagcttttcccactgacagaatgaagagatttttcagtcttttgcactttaaagtaagtctgcttataaggagtaaaattactttccctcctgggaaggtactaagaaaacagtagcaggcataatgtgttttcagaagtctcttaagtgatatattaagcaaagacaatactatattagagtataagaatataggaagaaataagaaatgaggtaaaatcaaatgccagaaacaacttcatattagccagcttctgaggaaatcaagggatcgcattacaaaacatcatcttcaaagtcaaattcagaaccactgtgactggtggtttatcttcatcaaaagcaacaacatcatatcacctttcctgctttctatgtccctgtagttgctgtgacctctcatttttctcagatattcttctaatccttctacttctttccattctattttctacttatttagtggacatccattgagaaccttcctggtatctataaataatctaactagcctctaatttcttccttccactatacacccctgccagataaatctttttcaaaatctgggttttattattttcctactcaagaatgacttttaaatatagtttaaacgctctgaccaactgctcaggacttcagaaatctgacactgtccttcctctcccactgctgcccgttaggcatcatatactccagcctagctgaatgtctggttctctttcccctcaaacatgtctttgttcccatttccccctccacttagaatatttttttccatatttatgtgtcctagttcaattcacacttgaagaccatatcatacctcaagtcatatggcaagtcaggattaaagtaagtaagttatgctgcagaaacaacacgacaaagtttatttcttgttcactctccatgtccaacatgagtcagcagtggggctcttgtagtttttcatcaagaagttgggttttgggccgggcatggcctgtaatcccagcactttgggaggccgaggcgggtggattgcctgaggtgaggagttagttagtttgagaccagcctggccaacatggcaaaaccccatctctactaaaaaaatacaaaaattaggcaagatggcttaataggaacagctctggtctgcagctcccagcaggattgacacagaaggcgggtgatttctgcatttccaactgaggtacccggttcatctcactgggactggttggacagtgggtgcagcccacggagggtgagccaaagcagggtgggacgtcacttcacccgggaagcacaaggggttgggggatttcctgttcctagccaagggaagccatgagagactttaccaggaggaacagtgcactccagcccagctactgcgcatttcccacagtcttcgcaactggcagaccaggagattccttacagtaccgggctcggtgcatcccacccccatggagcccagcaagctgagatccactggcttgaaattgtcactgctagcacagcagtctgaagttgacctgggatgcttaagcttggagttgggaggggcatccgccattgctgaggcttgagtaggctgttttaccctcacagtgtaaacaaagccactgggaagtttgaactaggtagagcccacagcagttcagcaaggccactgtgaccagactgcctctctaggcagagcatctctgaaaagcagcagccccagtcagggaattataggtaaaacccccatctccctgggacagagcatctaggggaaggggcagctgtgggcacagcttcagcagacttaaacgtccctgcctgacagccagcacagcggtcgagctctgctaagggtcagactgcctcctcaagtgggtcccggacccccgtgtatcctggctgggagatacctcccagtaagggctgacaaacatctcatacaggagagctctcactagcatctggcaggtgcccctctgtggacaaagcttccagaggaaggaacaggcagcaatctttgctcttctgtgtagacttcactggtgatacctagccaaacagggtctggagaggacctccagcaaactccagcagacctacagcagaggagccctgagttagaaggaaaactgacaaacaaacagaaaggaatagtagcaacatcaacaaaaaggatgtccgatcagagaccatatccgaaggtcaccagcatcaaagaccaaaggtagataaatccacgaggatggggagaaaccagtgcaaaaaggctgaaaactccaaaacccagaacgcctcttctccttcaaaggatcacaactcctcgccagcaagggaacaaaactggacggagaaagaatgattttgatgaattgacagaagtaggcttcagaaggcgggtgacaacagactcctccgaggtaaaggagcatgttctaacccattgcaaggaagctaagaaccttgaaaacaggttagaggaactgctaactagaataaccagtttagaggagaacataaatgacttgatggagctgaaaaacacagcacgagaactttgtgaagcatacacaagtatcaatagccgaactgatcaagcggaagaaaggatatcagagattgaagatcaactcaatgaaataaagtgagaagacaagattagagaaaaaagagttaaaagaaatgaacaaagcctccaagaaatatgggactctgtgaaaagaccaaatctacatttgatgggtgtacctgaaagtgacggggagaatggaaccaagttggaaaacactcttcaggatattatccaggagaacgtccccaacctaacaaggcaggccaacattcaaattcaggaaatacagagaacaccgcaaaaatattcctcgaaaagagcaacccaagacatataatcatcagatttaccaaggttgaaatgaaggaaaaaaggttaaggggagccagagagaaaggtcgggttacccacaaagggatgcccatcagactaacaaaggatatttcggcagaaaccctacaagccagaagagagagggggcaagtattcaacaatttcaaagaaaagaattttcaacccacaatttcatatccagccaaactaagcttcataagcaaaggagaaataaaatcctttacagacaagcaaaggctgagagattttgtcaccaccaggcctgccttacaagagctccgcaaagaagcactgaacacagaaaggaacaactggtaccagccactgaaaaacaccaaattgtaaagaccatcaacactatgaagaaactgcatcaactaatgggcaaaatatccaggtagcagcataatgacaggatcaaattcacacataacaatattgaccttaaatgtaaaggggctaaatgccccaattaaaagacacagactggcaaattggataaagagtcaagacccatcagtgtgctgtattcaggaaacccatctcacttgcagagacacacatagactcaaaataaagggatggaggaagatctaccaagcaaatggaaagcaaaaaacaaaaacaaacaaaaaaaaaacagaggttgcaatcctagtctctgataaaacagactttaatccaacaaagatcaaaagagacaaagaaagaagagcattacataatggtaaaggggtcaatgcagcatgaagagctaactatcctaaatatatatgcacccaatacaggagtacccagattcataaagcaagttctcagagacctacaaagagacttagattcccaaacagtaacagtgggagactttaacaccccactgtcaacactactgccaacactagacagattgagacaaaattaattaacaaggatatccagggcttgaactcagctctggaccaagtggacctaacaggcatctacagaactgtccatcccaaatcaaatcaacagaatatacattcttctcagcaccacatcacacttattccaaaattgaccacatagttggaggtaaaacacttctcagcaaatgcaaaagaatgaaaatcataacaaacagtctctcagaccacagtgcaaacaaattagaactcaggattaagaaactcactcaaaactccccaactacatggaaactgaacaacctgcacctgaatgactattaggtaaataacaaaatgaaggcagaaataaagatgttctttgaaactaacgagaacaaagacacaacgtacctgaatctctgggacacatttaaagcagtgtgtagaaagaaatttataacactaaatgcccacaagagaaagcaggaaagatctaaaattgacaccctaacatcacaattaaaagtactagagaagcaagagcaaacaaattcaaaagccagcagaaaacaagaaataactaagatcagagcagaacggaaggagatagagacatgaaaaacccttcaaaacatcaatggatccaggagctggcttttcaaaaagatcaacaaaatagaccactagccagactaataaagaataaaagagggaagaatgaaatagacgcaataaaaaatgataaaggcgacatcaccaccgatcccacagaaatacagtctaccatcagagaatactataaacacctctatgcaaataaactagaaaatctagaagaaatggataaattcctgggcacatacaccctcccaagactaaaccaggcagaagttgaatccctgaatagaccaataacaagttctgaaattgaggtagcaattaatagcctactaaccaaaaaaaagttgttgaggaccagacaggttcacagccgaattcgaccagaggtacaaagaggagctggcaccattccttctgaaactattccaaacaatagaaagagagggaacccttcctaactcattttatgaggccagcgtgatcctgataccaaaacctggcagagacacaacaaaaaaagagaattttagaccaatatccctgatgaacatcaaggcaaaaatcctcagtaagatattggcaaactgaatccagtggcacatcaaaaagcttatccaccacaaccaagttggcttcatacctgggatgcaaggctggttcaacatatgcaaatcaataaacataatccatcacatacacagaaccaatgacaaaaaccacacgattatttcaatagatgcagaaaaggcatttgacaaaattcaacaccccttgatgctaaaaactctcaataaactaggtatcgatggaacgtatctcaaaataataagagctatttatgacaaacccacagccaatatcatactgattgggcaaaaactggaagcattccctttgaaaaccagcacaagacaaggatgccctctctcaccactcctattcaacatagtgttggaagttctggccagggcaatcaggcaagagaaataaagggtattcaaataggaagaaaggaagtcagattgtctctgtttgcagatgacatgatggattgtatattaagaaaaccccatcgtctcagcccaaaatctccttaagctgataagcaacttcagcaaagtctcaggatacaaaatcaatgtgcaaaaatcccaagcattcctatacaccaataacagacaaacagagagccaaatcatgagtcaactcccattcacaattgccactaagagaataaaatacctaggaatacaacttacaagggatgtgaaggacctcttcaaggagaactacaaaccactgctcaacaaaataaaaagaggacacaaacaaatggaagaacattccatgctcatggataggaagaatcaatatcgtgaaaatggccatactgctcaaggtaatctatagattcaatgccaaccccatcaagctaccaatgactttcttcacagaattggaaaaaacttactttaaacttcatatggaaccaaaaaggagcccatataaccaagacagtcctgggcaagaagaacaaagctggaggcatcacactacctgactttaaactttactgcaaggctgcggtaaccaaaacagcatggtactggtaccaaaacagatatgtagaccagtggaatagaacagagccctcagaaataacaccacacatctaccaccatctgatctttgacaaacctgacaaaaacaagaaatggggaaaagattctgtatttaataaatggtgttgggaaaactggctcgccatatgcagaaaactgaacctggaccccttccttacaccttaaacaaaaaatcaactcaagatggaccaaagacttaaatgtaagacctaggaccataaaaatcctagaagaaaacctgggcaataccattcaggacataggcatgggcaaggactttatgtctaaaacaccaaaatcgatggcaacaaaagccaaaattgacaaatggaatctaattaagctaaagagcttctgcacagcaaaagaaactatcatcagagtgaacaggcaacctagaggatgggagaaactttttgcaatctacccatctgacaaagggctaatatccagaatctacaaaggacttacacaaatttacaagaaaaaaacaaccccatgaaaaagtgagtgaagggtatgaacagacacttcttaaaagaagacatttatgcagccaacaaacatatgaaaaatgctcattttcactggtcattagagaaatgcaaatcaatcaaaaccactatgagataccatctcatgccagtgagaatggcgatcattggaaagccaggaaacaacagatgctggagagaatgtggagaaataggaacgcttttacattgttggtgggagcgtaaactagttcaaccattgtggaagacagtgtggcgattcctcaaggatctagaaccagaaataccatttgacccagcaatcccattactgggtatataccgaaataattttaaatcactctactataaagacaccatgcatacgtatgtttattgcggcactgttcacaatagcaaagactgggaaccaacccaaatgcccatcagtgatggactggataaagaaaatgtggcacatatacaccatggaatactatgcagccataaaaaagaatgagctcatgttctttgcagggacatggatgaagctggaagctatcattctcagcaaactaacacaggaacagaaaaccaaacaccacatgttctcactcataaatgggagttgaacaatgagaacacatggacacagggaggggaacatcacacaccagggcctgtccagggggtcgggggctaagggagggatagcattaggagaaatgcctaatgtagatgacgggttgacgggtccagtaaaccatcatggcacatgtatacctatgtaagaagcttccacgttctgcacatgtaccccagaatttaaagtataataaaaaaaaaaatacaaaaattagctgggcgtggcggtgtgcacctgtaatcccaggtacttgggaggctgaggcaggagaatcgcttgaacccaggaggtggaggttgcagtgagccaagattgcgccattgcactccagcctgggtgacggagcgagactccatgtcaaaccaaacaaacaaacaaaaaacttgggttttagagtctatatcttggcatgtgcttctgtggataccacaggagtagaaaagacatacgaggatatgtgcactggccgttagtgtagcatcttaaattgttcttaaggctcttaaaacttctgtcaggttttaaagcttctgccaggaagtaacatatattacttctgcttctgctcacacttcattggccagaacaagccatatcgccatgcccaacttcaaaggagatggagaagtgtacttcagtcctaggcccagactagggtgaagcgagcaaggcactcaggggcagactactaacttctcatcaccatcctcaataatgggtggctgactcattttattgatttgaatgagtatggttaaatttgagaaggactatttcaaacattaaattcattgaatgaatacactggtcgattcctgggcacatatacgattctcttgatttaaagcacttgtctggaaacctttctcacttactcaaattgtgaaattattcacattgataaaaccttctactctggggatcagaataatagatgttattacagatgacggttttatttgatcttctaaaactgtttgtcatccattggttctaaaattgttcctcagtataatttggagcagttaaaacagcagaaaatacataattggaatgaaagctcatttgttgggatgcttttctcttctaggtgaggtgcaattcctacagaccagaagctgcccgagaacaagtccaaattggtgctcacagtccccctcagtttaggtaaatgggcaaatgggtgacggcagtttttaactgtacatctccccccttcctcccccacccagccatccaagggctctaccagataggtgatctgaaaaaaatcccacattgtggacgtgtgatttccattttgcagccaaaaaatatctggccacacggaaactaaatatcttctttcattagtagtaagctggtttagtcagcactctctcacctgaatttctgctgatggtacctgtacatatctagtctagtgctacatcaagtgccagtgagactatacaagactccagaggtaattcggaatccgaatcatagctttagtattacatcccattatcttctagtttttgaaagagtctcagtaaactgcattattggacttactcaactgcttacttttttgtccaaaaaaatagcctttattgtcttaggaaaggatgagatttgatgtactctgccttaaaacacctagcgctctggtttattttgttttaaagaatatcccctttaatacctcttgttctttcacacagtcaaccagcaaacatgaatgaatggccactttctaaatagctctgaacacaaaggaggatacaaagtattattcagcaattataatttatatctagagttagagagtctacattttggctttcaggtgggatcatattttgaaacggtagcttatacaaaaaaggaaaaggattatgaattgcagtcttatttgtcagaatgtataaaacattaagtacaaataaaattaaaagttaatattactcaccctgtactcggtcgtacaggttgacagaaattttctatagtaccggaaagataagtatgatgagaaacccaaaaaccataataatttatatgtattcattctttgtttagggcattatatctggatatctttatatttaatgtttaaacagatccattagcatattgcaagaaagccatctaaaatttcttctatatgttaaaatcttattcttaagatcttgccttagaaatgcttcagaaattgactataaattacccactagcataaaaatctaatcactatgttggaaatttctcccccactgggctaaactgtcatgaaggctgacggtctcgaacgtactaaaatgtgttcccactgaccaatggtgcagatgaactcacacagtagattaattactcaacagataagttttcagaaacttatttcctttaactagttgcctgtaatgttgaattttacagtgcatgcttactaattatcaactgtattctatctttaacacttgcctagggtgaatcacactatgaaatatgcatccctacccatatattcagctaaaacaacaagaggttatgaggattttttggatacagtccattacatttatgcaaatgcccgtaggtaacaaagtcattagggaagaaatagtcagggactgagaatgctgagtctctagtcaaccctttgaacacggagttgagtaagaaatagaaggggggaagttttttgtgtgtgtgtgtgctggcttgttactgaggtctgcagtaactatagattttgagtgcagcagaaatcacacaatggcaataccacttccaaaaggcagctacaatcaaagtgctgagtaggaatccagtctttgctgtagttggaagcctgtaagaatgtgacatattggagctaactccagtgaagaattatcagtaataactagataccattcattaattgactgattgttgcattaatcaaattctgggcaactgtgagcttcccatacctaacactaattcagagaaaatgttttgcagattgaatgaattctttaaaaatagctggaaatgcaacaacatggatgactcttatagacattatattcagtgaaagaaatcaaagaccaaacagtacataccatggattccattcacatgaagttcaaaatcaggcaaagctatggcaatagaagtcagaatagtaggttatcttgggagatgctgttggtatggaacaggcaggagccttctgggtgctggaatgtcttgatctggcagatagtaatatgggcatatacacacaaaaactggcaagtcctacgtttaatattttgcatactttatgtcagttatactttccataaagtttttaaaaagttagaaaaactaatattggtgatgatacagttttaaaagaattttgaagactgttcgaagagtaataggggcatgtgcttggcattcaggagatgctggatctagtctgttaattttttctggaaatttacttaatcattttgggctttagttgtctccctgtaaacagattaaaagaatgccaaccttctttctagcaatattctgctacagttttatacagaacctgttgatgtgcaagaattatatgacatatgctttgacatatcgtttttcagggtcaatggtgcaattagtaactttgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggagactttcatttttagtgcattttcattatttgggtaggtgacctgcttggatctagacagcatctgttcaaagttgtagggcttataaagtggaatataagaatgaactaagtatgtttctttagaaaatcaaaccaacaaaaataaatccctaggctacttttgttaaaatgctatctgctaaattgttgctattgtccattttagggtgttggccacagttatgtggtacatagcatttcaatctatagctttgtgggaagcctaaattgatgtatcctttaaaagttcaatctattaaacttgtagcctctcaatgatgaagacatgtgcatgaatacctgggagggcttgctgctctgtggaatgcagtgcacgtttttatggacagtaattacacagcattcctcaactgtaaggtagttaaattagaaatatgtttgatctccattttacactttttgatgaagttcttgccttcagctttggagtctgttggaatgaaactgtgtctcacagcttgcatctgatgtagcagattgccctgttcaagtcagcatgaacaaagctcgcagaaaggctactaggtaacggatttgagtttattcagtagaaaaaaagggaatgaggacatatctttaggtcccagaagcagcaaaacctcctagttacataacagcagggaaactaggagatgaaatctccaaaattttgtccagtctgtatgaactgcagtgattgtctgtctgctagacacttttttttagcctaattcttgttcgtttcattaccttcatatgtgtgcattgtactggttttgaaatgagcagacattgagaaaacaattttctgattccccattaggaacatatgattttcatttccctttagtgcaaaggaacaaacatcacattgaggagggagaagtgtacccttctttttcagcttaatgttacctctctttaaaaaaaaaacatttttgaaaaatttcttgactgatgacattctagaatttattgattcaatttaaaattccctgcatagtccaaataaacataatttttactcttcaagtcatctaaagagttgtgagaaagagcagtactatgtgttttatccttagagcattatccttctaagtgaactcctttcttattactgagcgtgtgtgtgtgtgtgtgtgtgtgtgtgtgtgtaggataaaattgtaatggccttaaagttgttacctggcatttttggtttcttaaaataggcatccccctactccctttacattattcattagacatgaggtgctgggttaagtgggccaataggaaaatctcaaaagcaaaatgacaaattcagattaaccacaggaagccattgtgtgtccctgtgatttgtgattcttttaaaaaaaaaaaaaatatatatatatatatatatatatatatatatgtatatctacctaagtgtgtgccatgtccttttgtagccatgggaacgtttgaatggagaaaaatggaggggcaccatcatgaggaaacaattatactgcattagtcagaggagagcgattttccctttgacttcttcctctctgaatggataaacttgtgaagggcagctaccttgtcctcctcttaacctggcttaatgtgaccttagtttgtatttccaaaaacaagcagtattaggttggaattgtatgtgtcttttctctggaggaagcattctgacttggtttagacatataagatactctgttttattcctggacttgggtgtttaaaatcagctgaggtttatcatgcttatatgaatagtgtttcccttctagatttcctttataaactccaaataaacacattcctgcaggtcagagaaagtgtttgataaaagcatagaattatggctttggaaagacaaactaagtcacttgttggtttagcaaaactggttggtgattagttggggccctcacagtttctagatgagaagcttaccttatcctgattaactttacttgctgtaactgttataccgaaaattgtaggtaggatgtccattactcaaacaaagcagaacaaaacaacaaaccaaaagcagcaataccaaatcatcactactagctagaacaatgagaaggattgaatttccaaatacatgcttatgtttaactcaactcttccaattacattctcattgtcctttctcttggataccgattgctaagataaacagacactgattaagtggtagaaagagaaaggtaaaatgcaactggaagggaaagaaaaaagtagggagaagctggcctatggatgtggctttgaagagaagacaggattttggcattccttgctaagcacgttcaatggaggagagccatgaagttttacaaaaataattatggtaaattaaaaggatattagatattggatctcagactagggctgctataatacagttctctgattcgcacaccagatgttctgccagcgaactgttgtctgggcattggaaggagttaggttttttgtgtttgtgaaaatctcctggattagtaaaaaaattttctagatataaagtggttttatttgggctcatgaccattgcccaaagtgtactgagcttttcactaagtgctcagcattggcctcctgttctcatttattcattttatgagatggacttggacatcactaatgcaaacacaggattcataaattattctgaagtttatttagtgccttgcctcaatggagcttaaagcatagcacataaattttatcttatttagccctggagcatcactaagaagcagctaggaactatggcttgccagacagattatgcttgtgccagagaagtggagaagcctgaaatcccttgtcaagtattccacaggaaggaaaggtagtctttgggctttggtctactgacctgtggattaaactctatcccttagattatcccatttctaaatacatttattcaatcagtatttctataatcacttagcatttgataggcttcttccttgatacatttaacataacgcctcagttgcatattacattatggaagaatatacgattgcttcatataacaacattctcatcaccagtgacagtgtcctactggtttgaagaaagatattcttggattatgtgttttatatctaaatggttattctgagactggttgtattttcttctcctactcgtgaaacgatgtgaacaagcattttaaggacaataaaaagttagctggttgaa

SEQ ID NO: 3295 - DNA, 215284 bp, human
ttagtagaagagcaagaaagccttggatgtcaacgcctcgctcttgagaccagccaccaaaccacgaaaagtgactttcttctcgtgtgctctctacggcccttctgatggaagcagaaacagggagcagcgtggagactggaaagaaggccaacagaggcactcgaattgccctggtcgtgtttgtcggtggcaccctagttctgggcacgatcctctttctaggtaagtggagtgcaggaggccgggggaactgggtgtgtgtcgagaagtttccttgtgctttattgtagcaaaacttgtcataacacaggtatagggctgtttgcctgcgttcataggtggtgtatctttagtttctatcaaatatgcaaatgataaagaaggcttttttaaggagcctaaataaataaatacacccaagtaccaaatgtatagtccagaaggcaaagtgggtgtaagtggcttcgagtggctggctgattctgttgcattgggtggaaaattttttatgtggtacatttagcaaaatgagtgtttgtgaattcatagtcacatagtttcatttatattttgaggaaagactttacattgtgatgaaaaccatgctggagtgtctttccatttgacttttattaatgtttgcttgaacgaatcatgaaatttaattcacaaaacacaaatcagtcctttaaagtgtgcttttaatgatattcttcaattcctttcttatccagtgactctggtgagatgcaatttgatttacaaattaatatgaaggaaaacagaggttttcccccaagatttgaaagatattgtgattcagttattttaatgactgttggtgagaatgatgtacccagagagtatataggatgatagaagtgtattcccatgaaaaagaatcaaatatcttggaaaggagtgagggattttctaaaattctaggctttctgaacccttgactattaccgttttaatttttctcatacaacccataatacttcattaacttgaacgttacataggaacgaggagattctaggtgcagtttgaaatgtagcaaacctgcaggaggccatgtttattttggcaggggtaaaccagtaattaaactttaaaagagttagggttgtgtggttgaaaactgctaaaatgagcaaaccatctttccacgctttctgtggctgaagatttaggaaattagatgggtttattgctttctgataaagcgaaatctcctactcctgcaactgaatctgtggctcttgaaaactcttgtaagatttctcagcacttagggtttaaacaagggtcctctgctgaaattccaaacaagaggaaaaattctatgggcatgccaaaagactacaggctacgtgcaacgtgactgcaaggttaggttttgcaaatgctcccaaacttaaaaatcccaataattattgtttatgtaaaaatatgtactctttttaacgatattaccactgcacgaaacttttacaaaactctacttttatgattacctcctgaggccgtggcatatcggttgaaagattctccgcggcagcaaatctttgttctttcagagaaaattattctcaggaaatagtgccgatgtttttagagcaaagtaaaattcatcaagccagacgctactattatggataaggaggcctgcataaaatatgaaagagaactttccagcgtgcccaataacctggctctcaccttgactctctaagaggagctcaaatgatgttagagaataagggcaaactgaggctgtggcctctacaactttgcttctcaaaatggggtctgtggaccagcagcattagcatcactggggagcttgagctccaccccagacccgctgattcacaatctgcattttcacaagacccccaggggactgtttgcaaatgcaggtttgagaagcattgcttcaggtgaccatatctatttggatgtatacattcagggacacttctttttgtcaaatatttctgcactattttagaatcacccccttaccccctctccccgtccctctcctcaactctgccacccacctccactctgcacccaggcaaagtgcttgtctgaaaagctccagggacctgcctggcaatgctcttcatgacaatattctagttagggtcgtcgtctcttcaaggggcttcctgcttgactttgtggtatatttctctgcctgtccacattcacttacatgcctgcaatttctagcatcccttcgtacctcatctttgtatctgaggctctgggataatctctcctcgcaaccttagtgcttctacagtaagagtgattgccagtggtcttgcagtggcttctgagaagctacagagcaccagaatggaaaacctttcttcttctccttcccctctctttcctccccacaatctgtttctcagatgcactggctggcaaactttttctgccaagagccagatagatagtgaatatatttggctctgtgggccatacggcctcttgcaactactcaattctgctgttgttgcacaaaagcatccatagacaatatgtacacaaatgggcatggctgtgtgccaagaaaatctgatttctagacactgaaattggaatgttatatacttttcatatgtcatgaaatattattttcctttttatttttcctgaccatgaaaaaaatgtaaaagccattcatagctcatgggctgtacagaaacaggcaatggatttgacctacaggccatagtttgctgacccctgctttctggccattcttatgctcttgatctgtggatgactccactgcatcctaagggcatttcctctggttatagagaaatctacaatgagaaaccaaactgctatttacatgtattttttaaagctcctaaccattcaaaagtaacatcttaatttttatattaaaaatattttctttattgtctctatttcattcacttacaccttcacattatctgggcttattgatcctcatttatttggagaattttaaaataaccccatccatggagataatgctcttccttgaggggttgggtctgtcagtgtcccaattaattaattatacacacacacacacacacacacacacacacacgtacatatatatatatatatatatttttttttttttttttttttttgagacggagtctcactctgtcacccaggctggagtgcagtggtgcgatcttggctcgctacaacctccgcctcctgggttcaagcaattatcctgcctcagcctcctgagtagctgggattacaggcgtgcaccaccacgcccagctaagatttgtatttttagtagagatggggtttcaccatgttggccaggctggtctcgaactcctgacctcaggtgatccgcccacctcggccacccaaagtgctgggattgcaggcctgagccaccgtgcctggcctaattagttatatttaaaaccttccttctgctcatcgttagataaagatacctgattttacttcttcctttgaggttttgggtcaagaattatctctcatgaaaggaataagtctttaacgattttattagctattttgttttttaaaataaggctaggatcaagaaggtattgtccagaattataaaaatattatttacaataaagcttatttttgcattatataaaagaacacatgctcactaaagaacattaggtcaacatataaaaattgactgatggggaaaattccccctgaggttctgccacccaggcatattggaatattgcacactaatctttatgctgcccatatatatttttttacataactttttttttttttttgctttatacagaaatcaaaacacacctttttgctaagaaacttattttcttaaaaacaggactgagatgggccaggcgcagtggctcacacctgtaatcccagcactttgggaggtcgaggcgggcggatcatgaggttaggagatcgagaccatcctggctaacacggtgaaaccccatctccactaaaaaatacaaaaaaattagccgggcgtggtggcgggtgcctgtagtcccagctactcgggaggctgaggcaggagaatggcgtgaacccgggaggcagagcttgcagtgagccaagatcaccccactgcactccagcctgggtgacagagtgagactcttgtctcgaaaaaaaaaaaaaaaataggactgagatgtttcatcggcagttttcttgaatctctaatgtaacacaatgcaatgcaaagaggctgtttggaggatggcagcagagaaaaagaacaaaggaaaagcaggctccatttagagagtgggttaataaataataaaaactcgccacactgggtagtaatctacaggtcttccatctctagcagaaatataggtactgccgagctttctgccacagagggccttggtccccattcacctcccaccatccctctccccatggccacatctccaaatgattcattgtttctgctcacagagcacagcaagaatgaattccccagaatttcctcagctactacaaatacttttgaaatcttaaactaacatctgctaatgcccaggtgctacctggggttgacaaattgggcacccttctgtacttctgcagacacctatttagataatgttgccaggcagatggagatattaagccattggtgaaaagctatttcaattttagacttttttttttttggagtgggggaagggaggaaatagctggaagcttggtccacaaagttgcaaatgtctggtagctaagctgggcctggtgggcggagagtttgtggggttcagggcaggcggacaatgactgttgctatcaataggtgattgagatatgttcagtatattctttacccctaccccttttttggtccgtatctgtatggatggtttagataagatccagaactctaaaagccaaacatgctagctttctatttccactctgattggctccaaatgacatagtttaaaagtttcaattttcccatcttgaacatgggcatggagttataaaccaatagagtgaaagtatgagacttaaaccactgataattggaggctgaagcgactttagagagtgtctcgcccagtggtgctcatatttgagcatgtatcggaatcacctggggggcttgttaaaccgcagatggctgggccccacccccagggtttctgagtcaagatcttggagtggctttctaacaagcttccaggtgcagcagcagcagctgctgctgctctagagaccacactcttaggagctctggtctagttatactcacttatcttacgtacgagagaactgagtttcaaagcaaccaagagtcttaccaaggttatttagctagcagctagagtctggtttcgtgacattgaaccaactgggttttggaataccgtgtcaacactgagaaggatgaactgatatcaaatatcttgcgtatgtttccgagggtggtttaccggatggtggtctgctacaactcagccatttattgtggtctgttttttcagtgagtcaaggtctcttaagtctccaagctaaacaggagtactgcctgaagccagaatgcatcgaagcgggtaagtcacagttttccatcctgtgtcaagttataattatggtaccttgggaagtggaagagaagacaggtggtatttttagtattctgtttgcttgaggtttaccaagtacgaaatgcaattttgaagaaattttaagtttattttcaagttttggtgtgaaacagtggagcttaggtttcctgttttctttttccttgcaaaaactgtggtattctaagcgttgttacaaggaaatcaggaaggggcttggaaggctgaatggcctctcttaagacccacaggcagagaacattggtcttcctatggctccgctggctatgaattcctctttaccttaagcagttgcctatcttctggtctgtgggtctgacttgcctgcctctaagcaaggctcctttgcaaataaatccacgcttccattgtcagtgggagtcccttttctcttttttaaaaattgagacggagtcttgctctgtcgcccaggctggcacgatctcagctcactgcatcctccacctcctgggctcaagtgattctcctgcctcagcctccctagtagctgggattacaagtgcccaccaccacgcccggctgatttttgtatttctagtagagacggagtttcaccttgttggccacactgatctcgaactcctgacctcaagtgatccacccgccttggcctcccaaagtgctgggattacaggcaagagccactgtgcccggctgggaatctcttttttctgtcacacgttgcaagtcaaacttctcttgaggtgaccaggctgtgtatcagtggatatcccagggtgaagatgagtgtttaaagtggccgcagttttgccacagtgtcttatcccatcaaactcatggctggagttgccccaaaagcagcaacagggaaattcccatgagggaatatcccatcccgagatggggccagttgggattccaaagaaagaagcactaaataaatgccagggcggccggtcagtccaaagcatttattagtgcaacttatgttgaaagtgctgcagtgtatcctcaagacagtgagagaaaaggggtgttctacttagggcattagggtgtggagactatatgcgggtttaaggaatttggctcagagccggtactagtttctttcagtgttttgtgcatcaacctagatacctttatcagtgcctgggaatgttcaagggtccagtctggacctaagcctgctgggaaaaaccagcagctggaattagccgggcatggtggctcatgcctgtaatctcagttactcgggaggctgaggcatgagaattgcttgagcccaggaggcggaggctgcagtgagctgagattgcaccattgcactccagcctcggtgacagagggaacttctgtctcaaaaaaaacaaaacaaaacaaacctgcaggtggctgggtcacagagtggtcaggggattgtgtaatttttggttaggacaccgaaagcggcggtggggaggtgaggggaaacctgggggtcccacacacagctattagatttccctcctaaatcagtgttagggcctagatttcagggagccagattctagccctcaccctcattctttaagtgggcagggacacttttttcctttttccaaaaggaaagtcatcaaacaagcatgtggccctttcactttcctcttggccttaaaaggttaatgaacaaattcaccaaatatttgttgcacatgaggtactgagttaggttttggaaatagagcagtgaaccaggtatgggaagaaagacaataaggcaattaatacaatgagaaaattatgaaactgggtgtggtgacacgtgcctttagttccagccacatgggaggctgaggcttgagccctggagttggaggccagcctgggcaaattagtgagaccccatctctgaaagaaagaaagaggaatatcagtcagtggaaaatgttatagagaaaattaaaaaaaagatagaacaatgtgatagcaagtgacaggatggctagattgaaaagccggaggacatgaccttggaggtgacctttgaatgatgaggagggaactgctgtgtgaagactgaggcaagggctttccaggtggggggaacagatggggcaaagggtgcatagaagcatgaacttggtggacttgaggaacgggaggagcttgctaggtgaggtgcaagtgatgaggagtcaatgggggacccaagtgccagtgagtttgggctttccttaagtgtgctcgaaagcctctggaggcttttatgaaagagaatacatcttaggagcatttcaaaagatgtctcggtggagggctcagttagagggagtctttcttgatggagaagagaccatagggagcaagaatagaagaaggtgactcaagtaggtttatttctgtacgccaggtgacagacgatgctgtcttgaattcaagagatggagagggagaatgggggaaggtttaggaggtagagggcctattgaaggattcgatgcaggctgtgaacaaaagcagacaattgtgggtgacgcttagatttttggtgatggttgggcagtggtgtttattgagatgggaaacacttaggtgaaagagcttgtaaattcggagaccttatacaaaggtagtggcttagataattatgttagtagagttctttttttgttccattcttaagtgatctctctctctctctctctctctctatatatatatatatatatatatatatatatatatattttaaccaggctgtgtgttgagtgccttacaggcaccatctcataaaaccttcataagacccctatgaagtcagtgctatcaccagcctcactgacagatgaggaaatggaggcttctggaggctaaataactgcccagggtctcatcctgagttagtagcagagctggacttcgtgtccatgtctggctcctttccgtcttttccttggtgatatggggccatgccaggcaactctttttggccctggaactatctgagaactcccaggccctttcctgctccaggcttgagtagttgacctgaggttttctccagtggtgagagattgtcatggagtggggtgagagagcaggcggaactatcaggacaggttttagagtttatgtcacctggtgctttggctgtggtggggttcttgcagatgtgtgaaatgggaatttttgagctcataaattttcaacttgagtttagaacacttttttgtatggaaggccacttatttcatgagttttagttctgtattatgaatcataataatgcaagactaaaacttacagactgacattcaaagatgttgccttctgccagctagtgtgttctgccttgctgtcctgtttttaattttcacattggcgaatggctttctaatgttgaaaaaaaatattgattttgctgtttctggagtgaaaggctcaccaaagacccagttctctttagtgtaacgtgagcctcagtgtgcccaggggtctgcagaacagctgtgagtacacatggcaggagaattacggccaagccagggccttaaacaagaggctgtgcgtgcgtgggcgtgcatgctgaaagttcagaagactagagtgtttgatcgccttctggaccatttctgagcaggtgccaaccacttctgagatgcttcctctccataactctcctcttctctgtgtcctcttattttaatccctctttcaaaataagagctgtgcaaagaatgcaaagaaacaaggaaagggcatgcatgctcatgatcacagataagggcagacaggctgactgggtttgaagcatgatttagctatttacaagccacatgatcctgggctaaatatatagccacgctaagcctcagtctcaccaagtgtgaaatgggaataacaggttttacttatactagtcgtgagaataaaagaaaataataatggactgggcacggtggctctcgcctgccaccccagcactttgggacgctgaggcggacagatcacttcaggccaggagttcaagaccagtctggccaacatggtgaaactccatgtctactaaaaatacaaaaattagccaggcgtggtggcgcaagtctgtaatcccagctacctgggaggccgaggcaggacaatcacttgaacctgggaggtggaggttgcagtgagccgagattgcaggttgaatctgcacttcaaccccaagggggaggttgcagttcagcctgggcaacatagtgagactccgcctcaaaaaaaaaaaattagaaaaagaaaataataatggtagtagcagtaatttaggttcacaatgctgattcttaaccccaaacccagaaaacgatgtaactctcagttggcaagatgggggcctgatctcaattcctttgatggcaaaattggatcttaactcatgtgaggctgcttcagatttcatttatcctacttacaagaatatgcatatgtttccctatagaaacattaatgcacttgcttcaggcctgccactccagccattgctgaagtattacatgatctgtggttatatgcaatgtatttattttctaaaatctgaaaaatctatgagctctgaaacatatctaacctcaagagtttcagataagtgattgtggaattacagttcccagatttagctaactacatacatacgtacatacaggatgcttagtgaaatttgattgcagatacacaatgactactttttctggtgtatgtctcatggactatttggtacctacttattctaaaaggtggttgtttatcagaaattcagacttcactgggcatcatgcatttatatggtaatgtgcccaacactattctaagcactttacatatatttaatttgcataatgattccatggggtgctattattatccccattttcaggtgaggaaactaagacacaggttaaatcacctgcctaaggtgtcttagctgctgcatggtgtttctctcattcaaacacaagtggtctgactagagtttgtgacgataccatattgctaaaaaagggcttagcgtaggtcctggcaaaaaggaaatactcaatattggtgattttattattgttaattattattattactactctctcccttcatccttgattaaatctaaaaacagaggctggtatttagggaggatgcctccacctctaccacacaaacagcaactggtgactgtgtgacaattaaccttatatatagtgacttggaagagtacacagcctgagctttcacagatttccttcatcatcatatttcttttattaaaacaagactctgggttttctccatggagctgagtagggggaaaggcgttttggtgtcttgacaactatggtcccttgcaatttgaagtcacagttcccctgcagaaagtgcagccctgtgccccgctgtgaattgtgaatgatgaattgggaggctgcaactagagttttctcactcagcaggcttctttccaaattcaatgtgagtgatgtatttcccaacttttgtatcagggccaaggtcagagctgaccttgcagtttttctaggtacctgcaagaatactggcgagatggagaggatacatttgagggttgggggcagggaaagtttgagaaggaggctggaaaacagtgtactcatgtgggtaaaaatgcgtgtgagggctcccctgtgtgactgtaaatgttgtgtgggactgagacgtgtgatccatgtctctgaggtgtcacatagcagattcattctgtggctgcatacagtaactataaataccaaccaaaagaaagattttgttatgtcctagcacatttgcacattaaatattaatgataaaatagtagcagtaagtggccgggcacggtggctcacgcctgtaatcccagcactttgggaggccaaggtgggtggatcatgagatcaggagatcgagaccatcctggctaatgtggtgaaacctgtctctactaaaaatacaaaaaaaaattagccgggcgtggtggcgggtgcctgtagtcccagctacttgggaggcagaggcagcagaatggtgtgaacctgggaggcagaatttgcagtgagctgagatcacgccactgcactccagcctgggcgacagagcaagactctgtctcaaaaaataaataaataaataaataaataataaaaaataaaaaagtagcagtaattaaaaatgtaattagagacaactgatgctagttctgaagcacgaaaatgttaagccaatttgaaatttatcaaacttctaagtctttatttttatttatttttttatttttttaagagacggggttttgccatgttgcccaggctggtctcgaactcctaggctcaagtgatctgcccacctcagactcccaaaatgctgggattacaggcatgagccacagtgtttggcttctaaaccaattttttgctagtgttttttttttgtgtgtgtgtgtgtgttgttgggggaggtttgaaaatggtggggattttgaggccctatagaaattagaatgtttttatattattcacttcattgaagacaaaaggctgtttgaaatttttgtagaaagtctaggctggagaaatatctagccttatttttaaacctggaggaaccacacatgtaaccaaactgtaagatatgtatctaaattgacacagattgtacttttttggggcagttcattcatatttagctgaaatctctttgggttttcattacttcaaacaaaaatatattctggcattatttaaagtatgaaaattgcccagaatgtcatcttttcaatgtcattaaaatattgtctggttttttaaaaaaatcaattggtacataactttgtgctagaatggtagccagcaattgcatggcagctggaagagcattggagttcaatattgggaattctcattttgtaatgaagggttttcttttaaagttcatggttacatatttatgcacacatctcctacctgtgggttatcttctatatgtaattgtgtatgggcttatgaaagaggaaaaaaatggtagatcagtctattgtgtctttctgttaacttatacacatactcagttctactgctagacctgggtccctcatttagaacaccctactttggccctcctctggccatgcctctccttcagccaaggcgtctgtggagccaagtaggcagccctctccttctacaccccagaattccctgcctgatggccccaagctcccttccaggatctctgtgagtctcttctggggcttcatttctctgagagttacactgaatatcaaggagctcaagaatttgaaagtattttgtaaatataacttttaaatatttagatagatgacatatgaacttctgtttccattagccttcactgtgaggcaaaccacccaaaccatagaggcctggaacaaaaatgattggatatttctcatgattttgtggatttggtggatggtttctctgccgatttttgcctaggctcatttgtgccactgcattcagctagatgggcgcctggactggaaggcgaatgatggcctcagtcaatgcctggcagttgtgctggcttggttcttctctatgtgtcctcttgtcctccaggaggctgcttcaaagggcagctaaagggctccattcaaagggagttaatatggaaggtgcaaggcctcttaaggcttagctttgaaactcacagaaagttacttctgccaattctgttggtcaaagcaagtgacaaggtcagtccaaattccaggcaggggaaatagactctaccacttgatgggaagagcagcaaggtcactttgcagaaggacaagcaggatagaagaaatagtcacagttatctttgcaaacaattgaccacacgctctatttgtattcttgtcccataccccacagatgttagggatggccctgcaaaaaccagtgatgataataccaccaaacttttatccattccctttttttttttttttttttttgagagacaggttcactctgtcaccccaggctggactgcagtggtgcgatctcagctcactgcaacctctgcctcctaggtttaagtaattctcctgcctcagcctctgagtagctgggattacaggcatgcatcaccatatctggctaatttttgtatttttagtagagatgggttttcaccatgttggccagactggtctcaaactcctgacctgaggtggtccacctgcctcggcctcctaaagtgctgggattacaggcatgagcccttgcacccggcctatccattcactttgaatgtagtcatttcatatagtgaggtagattcagagagtttatttaaggggaaatataaatgccaaggcttggaaactggttgatatggaattgttgtttaatttggaaaagaacagtatacaacattcagtgcttgtcattaatcctatgattttctttctaaatagctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaagggtaagtttctactggggtttggtgatacactttatagagagcaatatttgacaggaaaaacatagtttgggatttgaagcatgacttctcactttttaactaccatgctaaattcatttccaagaatttttaaaatgaaagattgaaaggaaagtttgcagaattctggactcccagatctcaacataagactaatgtaggttgttatgttcatgtttggtaatagtaaattctactgccaaaggataaagagcatttgattgagattggaagcaaaggaatagttaatgaaaattatatcaatatactcatttgttgtattcagagtaaacttcatttcttgctcattgtgtcctggattttcatggcttacaaaatgtacttaacacctcatcatcttttgacatcacttttgagaactctggatgaccttgtggttgtcatattgttcttgttaacttctaagttggctctagggagattcacttttctcccatggccactctagcaatgacaagctcacacacacatactcacacgtggatgcatagaaacatacatatgttctcaaatacattcccctgccccccgccaaagttggaaatgtctgttattggaggatattctgttagcattggatctaatttttatgctaagctattggagaaggccacctcaggagggaagtaggaagatttcaaagccagataaggtaattattttgagaaggcaaaaatagtatggtttttttttttggctctttttgacaactgtgagttacaccatgtaacttgcattcagtaacacctacaaagaactcctgagaaattataaaaatcattttcccttcccatttacattttcccaagattttaaatacatgaaaattaaatatgtatcattttacaataagtaaaactcttggcaaaataaataattagatacctattgtcaattgtaaggaaaaatgtacttaaatttcacaactagatataaatcacatggacttatattttctattaggagacccaaatttagtcttggaaaattataaatgggaatttacaaggatgtcagggttttctcctaacccaaaaggaaaattctcatactataaaatcataaataagaccttgaggagtgagtttactaatacttttttccctgtagaacattaattcatgttggtctttgatttaccattcttgtccatttcctatttcccttctctggcttttcttaatagacagatgtgtacacacacatgtgcacacacacacacacgcgcgcacagtcatgcatacagaaacattactgaaagataagaaaactacaagatttccaggcatatgctccttttgcatttgttataacccaaagatttctatattcaggacatgaagtggttaacgataacttaaataactttccaggggtgtctggaattttaacataaaagttaaaatcagtgtcaatatgctttgtttgaggagggtactgtctacaggctccttcaaaatcaatagaaatgcaagtaaattgttaagcacagggtttttgtatttgctagcttccttttaaaaatcaaaaattttatttctcagctccattgaagaaataaaaaaagagcaaaaattagaagaaaggtcgctcataaatccgtcacaagaaataactgctaataaagcaactggggatatttctttccaggttttgttgcatgtgtgtgtccatatgcataacttcatatgcacacctatatattgtaaaaattagctgatattatacatactactctaacttaatttttaaaattagttggtattatacatactactctgtaacttaaaactatgcattcctcatagacatagattatgtcagtagataacttttcttttctttccttttctcttttcttttctttcctcttgtcacccaggctggagtgcaatggcacgatctcggctcactgcaacctccgcctcctgggttcaaacgagcgattctcctgcctcagcctcccgagtagctgggattacaggcacttgccaccacgcctggctaatttttgtattttttagtagagatggggtttcaccatgttggtcaggctagtctcgaactcctgacctcaagtgattggcctgcctcagcctcccaaagtgctggggttacaggcatgagccaccgcgcctggccaacttttcttattataaataacactgtaataaacatccttgtgtacacatctttatgtccttatctaaatgtatccttaggataaatttccagaaatggaattattgggttgaaagagtactctaaatttcatttttgatgcatatagccaaattgccttttagaaagtttatttcagctgggtacggtggctcatgcctgtaattccagcactttgggaggccgaggcaggtggattatctgaggtcacgagttcaagaccagcctaacatagcgaaaccccggctctactaaaaataaaaaaattagccaggcatggtggcacctgtaatcccagctactcagaaggctgaggcaggtgaatcacttgaaccaggagggagagattgcagtgagccaagatcatgccattgcactccagccggggcaacaagaatgaaactctgtctcaaaaaaaaaaaaagtttgtttctaggtctttatatttttttgatgttttaaaggataactttttcccatcaactgctttctgtggtataaagtagaagtcatcaaaccattgccagtaggcaaaatccagtccactgcctggaagttttattggaacacagccacatccattcgcttatgcattattaatggctgcttttgcactccaatggtacagtcgaatagttgcaatggaaactggatggcccaaaaagcctaaaatatttactctttgacctttatagacagtttgccaatccctgatgcctagtataaagtaaagctttgaatgtatgtattggattcaattagaactgtcttattagttgatagctccttggtagcttctttgaatttcttagatagttaataaagttaagaaataccagaacaggctgagcgtggtggctaacacctgtaatcccagcactttggaagaacaaggcgggtggatcaccttcaggtcagaatttgagaccagcctggccaacatggtgaaacctcgtctctaccaaaaatacaaaaaaaattagccacgcatggtggaaatcccagctcctcaggaggctgaggcaggagaactgcttgaacccaggaggcggaggttgcagtgagctgagattgcaccactgcactccagtctgggcgacagagtgagacttcatctcaggaaaaaaaaaaaaaaaaaaaacagaacggtgttgaaataatagcaatgataatgggtgtaattttcttatgccttgcttgggtggtaatgcctccagtatttcccctgaaaacgtacactttttttgtttgtttgttttagatagttattcttttttgtgttctgttgttcctagtttgcaaaaagctgctgctcaagaaaaatgcctctttgccatttatcaagagactcagatggagtatctcttttaacttatcttgatttacccatgctgaactaaacttataattttgaaataaatcctgcctattaatggtttgtattttttaagacattaccagaattgaagaagctagcattttgtttcacacatttgtctctatatttatgattcatattggtttgtgattgttttgtgtgctaggtttgtcgaattctgttattaagattgtgctggccttgtcaaacaaagtgggaggcttcctatatgtgtttctatgctctgggaaagacataattcaataaatcccaagttactctatgacaagcactgtaaaggccaaattcacaaactgacattagggttcttgcttcatatgtcaagaaggagagcaaatggtggaaaaggatctcttaaaattagtattttttaacaaaaataggtaaaatataaaatagctggacgcagtggctcttgcctgtaatcccaccactttgggaggctgaggcaggtggattgcttgaggtcaggagttcaagaccagcctggccaatgtggcgaaaccctgtttttcctaaaaatacaaaaatcagctgggtgtggtggcaggtgcctgtaatcccagctacttaggaggctgaggcaggagaatcgcttgaacccaagaggcggaggttgcattgagccaagatggtgccagtgcactccagtctgagtgacagagtaaaattctatctcaaaaaaaacaaaaaacaaccgcataaaatatctattagatttaaaaactttttattttgagataattcaaactttgataagttgaacaaatagcacaaggaacttctatgtaccctttacccagattccctgattattaccatttactacatttgttctattatatatatactttcattttccatctgtaaatatatatatagtgtatcatcctctacatatatacttatatacttttatacacatgggcagatagtatatgataaaataatatatctataaatgtagagataaatatcgatataaatacagatacatagatttttttctgaactctgcaagtatgttacagatgattagatattcttaaagtgtatagaggttttcaaatgtcaaatgtgctaaaaatcttatttcttttcctgaaacactgaatctttaaattctatctatatcttttaatatattctatatctatctatttatgtgtctgtcagtctagctacctagtcatccaactatctattcatttatcattctatccaggtaatacaggctcatcgtagaccaaccacaaataaacagcaaaagaagcatacttcaccacccagcaataacaactttttaaatgcaaatataggtataaaattatacatatcttctaagggatcatataatacattctatttaattaatttatttacttatttatttatgacagagccttgccctgttgcccaggctggaagtgcagtagcacgatttcagctcactgcaacctctgccttttgggttcaagtgtttctcatgcctcagcctcccaagtagctgggattacacgcatgcgccaccatggccagatcatttttatatttttaatagagacagggtttcgccatgtttgccaggctagtctcaaattcctggtcacaggtgatccgcctgcctcagcctccccaagtgctgggattacaggtgtgagctaccgtactcagccggatatactataatttacttaatcaatgcctgtgttatttaggttattttttatgttttcttcattgtaagccacttggaacatgagtttagaaacatcaagagctggatttgaatcctgattccctttcatttaccctctatatcactttgggccaattactgatctcacctagttcagttttcttatctttaaaatggagataagaatatacatatcagagtatgcaaaggcatacagagtggtgtaatagaccttggactcaaaggggggagggtgggagaagggtgaggaataaaagaactacaggttgtgtacaaaatacactacttggtgacaggtacactaaaatctcagacctcaccattatccagttaacctacataaccaaaaactacttgtaccctaaaagctattgaaataaaaaatatatatattttgaaaaaaggggaaaaaaaggaatacccatatcatagggattttgtgaagattaaaggagatgatttatataaattacccagtccagttcctggcacatagcaggccttccgtaaatatttgtcctttgttcctcgctttgtttcaaagatagttctaagattcatgaagtaatgtctatcaaatgctttaagttttattctggtattatcctttgtgtaaatatcatgtgctttcaaaaatattgaatactgtcaagatatttttgctcactcttgataaaaagagagaacatcccaaaataaaacccaatactaccaatcgaaagaataccattttcttaaggctgatagaaaacacacagatacggctgtccaatttgtgaaataaaatggacttgacagacctggctgatgaaaaattgccctctactgaagtgagcaacctggctttgtgaatttttttctttaaatggcatataagactcagattccgacttgggaaataaaattacttcctattctctccaagaagtgagattttttaaaaagccgaatataatcatatgtttgtcttaagatccacattctataaaccccccaaatttgtcttcatgtgaccatgaagaagacacagcatgcattgcttatgaatgagcagatggaaatttagcaaatgagcacttatgaaacatgaggcaatgaatgagatagaacacttatgtcacacagaagacagatgactcaaggtacggccagatcatctctattacggaatagctatctttgccaatattttgtgaagaaatgcaatatattattttcaagcccagcttcagcagaacaataagatgaagtagggactctgcattaatgaacagaaagagatgattgtgattcatagaccatttatttgtaaataccttctggctgagattcaaatagttctcgtaattaaacaccaccccctccccaaataatctttttttctgtaaatgatcctagccaaatcatcttttgcagacaatggaaatctgaaaacttcagttcctataaagtcatttagtgattaggaagttcagattattgaaaacagtgaattgtcattttcctcatgttgtatgtatagtagagctttgacttcataaagttcttaattttttaaaattattttattattattttttgagatggagtttcactcttgttgcccaggctggagtacagtggcaccatctcacctcactgcaacctccacttcccaggttcaggtgattctcctgccttggcctccctagtagctgggattacaggcgcctgccaccatgcccagctaatttttgtatttttagtagagacagagtttcctcatgtcggccaggctggtcttgaactcttgacctcaggtgatccgcccacctcagcctcccaaagtgctgggattacaggtgtgagccaccgcacccggccacttcatgaagttctttgaaacaagtaatatcagactagcaaatgtggggatgcagtggggaagtgctaaggaccaagcatccattgtggtgggctttttattactagtgaaaactcagcttctgtaattttgtgtgagtctcctatgtaaactgggtgcaccccttcagagaagattcccatttttctcagatcatgctggctctttttcacgtggccacatagaaagcaacaaattgccaagttacaaatatatcaccacagtcctatatgtgcaaaggggtgctgcatgaagatttgggcctgtattgaagacttttggaatgtgagattaaataattttacttgaaaagtttgttgttattcatagttttcctgctctgatataccgtttgagtattggtaggtgtgcgtgctgcatggagtgtggggagaaggtaagaagttgtcagattagggctgggcgtggtgactcacacctgtagtcccagcactttgggaagccgaggcggttgggtcacttgagatcaggagttcaagaccagcctggccaacatggtgaaaccccatctctactaaaaacagaaaaaattagctgtgcatggtggcgggcgcctgtaatcccagctacctcagaggctgaggcaggagaattgcatgaacctgggaggcagaggttgcagtgagccaagatagcaccactgcactccagtccgggcaacagagagagactccagctcaaaaaaaaaaaaaaaaaaaaaaaaaaaaaaaaaaaaaaaaacagacctagtgctagatatgaaatattcccaacacacaaaataatgataaatgtttgaagcaatggatatcccaattacccagatttgatcattacacattgtattcttgtatcagataatcacatgtaccacataaatatgtaaactataatgtatccataatcattgaaaattggaaaactggacaaatatagaaatttttttttctgaaggctctgtggaagatgtgaatgtatctctaggatatgttctctttctaaatagctaaatgaactaaagaggccatcagagtgactactgtgtgtaaaagcttgtgttttggtagttctgacagtcagcctgtcaggttttctttttttttttgaggcggagtctcgctctgtcacccaggctagagtgcactggcacgatctcggctcaccgcaacctctgcctcccgggttcaagcaattctcctgcctcagcttcctgagtagctgggattataggcatgtgccacatgcccagctaatttttgtatttttagtagagacggtgttttgccgtgttggccaggctggtcttaaactccgatctcagttgatccacctgcctctgcctcccaaagtgctgggattacaggtgtgagccaccgctcccagacaggttttcttcttatgtgtgcttttccaccctcagtgcatgtccttgtcttactttttgactcttgtctgctctaagccttccattttaagatctgatctcttcccctattgctttaatgtagctcctctgtcattagcggtttctactacaaataagttgggtatgcttggtaagaaccagctctgttcattccattcattctaagttgtatgatattcagctggcgggaagttcaccacttcaaatagattgaaatgcacaacattttgattgtactactctgtgaaaatagtcttatttaccaagcatttacttttattcctggcactaattgctttcaatcgtaagtaacagacagcccaactcaaactggcttaaacaataaaatatgctgattcatgtaaccaaaaagcctagtaattatgtagacttcaggtaagggctgatccagcaactgaaccatgtcattaaggatcacattttttttttctttctctctctactctgacatccaccatgtcgtatttccttctaagtctgtttggtcatgagattgttgctaataaccagaatttatacttcctcattcatatctagcaagaggcattgtgttagacacaagggatacagaagtacaaagattaataaggtcccctaggctgggcggggtggctcatgcctgtaatgctagcactttgggagcctgaggtgggtggatcacctgaggtcaggagctcaagaccagcctggacaatatggtgaaaccctgtctctactaaaaatacaaaagttagtctggcgtggtggcgggagcctgtaatcccagctactgggaggttgcagtgagccgaaatcgctccactgcactccagcctgcgtgacagagcgagactctgtctcaaaataataataataataataataataataataataataataatgtcccctagactatcctcatggaaattacaatctgcatcttatgagtgttcccataggtattgtaatcaatactctagaactgtcctgctcagcatggtagccgctagccactgtggcttttgggtacctgaaaatatggctaggtggaattgaggtgtgatgtaagtgtaaaatatacaccaaattttaaatacttcattttaaaaaatgaaagcactctcattaattgatagtttcatttataatcagtaattgcatgtagaaataatattttgagttatattaaggcaaataggatataccattaaacatctcacctgtttctttttacttatttaaatttagctacaagaaaattaaaaattacgtatgtggtttgggtaatatttctaccagacagcattgctctagagccctgaacaggctattagcaaggtgaaatatctgggaataactcaaatggatttcagtgctagagaaagctcagagaacacctttatttaaaatagtcctctggctgggtgccgtggctcacggctgtaatcctagcactttgagaggtcaaggtgggcagatcacttgaagccaggagtttgagaccagcctggccaacagaataaaaaacaacaacaaaaattagccagacctggtggcatgtatctgtagtcccagctactcaggagctgaggtgggaggatcacttgagctggggaggccaaggttgcagtgagccaagactgcacaactgcacttcatccagggcaacagagcgagactcgatctcaaagaaaaaaaaaagaaagtcccctacccaatctccaatccctttgtatttgtgtcctttgtggtccttataaccatctgaaatgatgtcatttgtgtacatgcttgctgttcttctcacttacacccatccccgctcctgtagatgttaaactccatgagaaccagccccttgtccattttgggtgtcactgtgaccgcagcaccaagcatagtgcctgccataggaggtgctcagtaaatacttcctaaagaaaggaagaaaagaatgtgccctctgtggttggctgagtgcagttgtgggggcagctgactgggtagggaggagtggctttttcttctccgtttcactccatctcctcctgtgcccacagtcccagaagactcttgagatgcaactggggcttgcccctgaaaggaggggaagcaaaatcatcagtcattttccatttgtgttctgggcctcaggaaggcaggacagggacgtgggcaatgagacaggcctgggcccttctaagactccctgttggtgggatctgatgcaagttacagacaagaaaaataacttgcaggtggttcaagtttgggttctgagaaaagaaaaaaaaaaagggattctgccacttatcagctgtgtggccatgggcaaactacttctttctgagcctccgtttcttatctggtgatactgttggacaaatccaatgagatgcgtagaaagtcttctacacatggttcaataaatggaatccgttgctactgttaatttcacaaggattaatgttttaaaagcacttggcacatagtagatgcttaagaaatgttctgcagccaaataaaaataacttagaagaagaccttgacatcactattaaaataaaatattgtgatctagttttttttctcaaactccccacatgcctgtaaataaggaagctggttctgaaagaggcaaggctggagataaaaaacagcagatgaggacatttgtacgtattcccaacttgcattgccagaccttggtcatgaccctaaaccctggacggttttgataatctaattgtcagataacacattcattggaggccatgtgatttttaaatcactcccacaggaagagaaagaagaggaaaagggaattggtaaaaataagaataactatcctcttacgccgctctagagcttctctggatgccacttaaaaaaattctaccaatttcccttcttttttcggacatggagtctcactctgtcgccgaggctggagtgcagcagcacgatctcggctcactgcaacctctgcctccccgattcaaatgattctcctgcctcagcctcccgagtagctgggattacaggcgcctgccaccacgcctggctaatttttatatttttagtagagacagggtttcaacatgttggccaggctggtcttgaacacctgacctcaggttttccacctgcctcggcttcccaaagtgttgggattacaggtgtgagccagcgtgcacagccctcatttccctttgttctctcttctttcttatccctaggggatccttaacttgagtccacagtcttcccacaagagggctgtcaatacaattcaggtacttggatgggaaaaaattgcacctttgttttcactaacctctcacagaattttagcattttctttaattatgaatgtaggcaacaaaccctggtactattagcagtgcctgtgactttgttaccaacagcaatcatgattatttttctaccttattgcagatgttgcaggtatcttgaaatgttatgtacacgtatcactacttcaaaattatagtagttgtcagactcaaagttagggcttggtatttaatgaattaatcaaatagcacatatatatatttcacacagtaaaaaaagttgtgctgtgttttgaaatacctgtttttctttgtaagcctatgtttcttattttatgtacttataaacattattctcagaatggtccataggtttcaacagactgctcaagagatgtaggcagaaaaaaccattaagaaccccagtgtatgtaaggattgctagagcaagattcaagaaggcagttttatttagctccagcctcttgatccatcttaattcaggtgcttggagtggcattgactattacgtggcctcatgggtccactcatgcccaaatctttgagtacttcactgtctagactcccggggtaatgagcatgttactgacagttaatatgtgtttatgaggatattagatgaaactggagtttgtaccagtaccaacccttgaactgattaaatgcagtctttatgattgtctatgccttggaacctgtatattttcaggtgaaattactaaggcttgccatgtgcttatcatgaaagcagggcattaaaggtcaattctgggcctggcagtgtacatctgtagtcccagctactcaggaagttggagagggaagaatgcttgagcccaggaattcaaggctgtagtaagctaagattgtgccactgcactccagcctgggtgagagagcaaagccctgtctcaaaaaaaaaaaaaaaaaagtcaattcttattcgaagtgatatagcttttatgaacagtgcaaatgattggaaatagtaatacaccaagtagagtgtttatccataagcagatactacatggtgtacaacagagctagcttgttattcaatgttgaagacaggggctgttgattgaacttagaagggtggggagtaagggagtaggggaactgcaaacctggaggtgctgggagctaagtcctaagggtcagatccaatatatatagcttggctttgttggaaggaaggaatgaacagggcctttggtgagagatgacaggagataagagatgttgaaatccattggtgagatttttgacttgcagcagggaatgctaaggtttctgagaagtggagcaatagcctgcaaaatgctatgcatgggaatattggctgaaaaaaatgaatgggaaagcagacaagggggcatttttgtagcataaatattgccacacattatgaaaagtttcctgtgagttagcttgaatgttgtaggaggaaagaaacatttcactttagaagattgtgggctaaatttaggttcctttgactaaatataagttcctcagcatgactaataacacaggatatgtgcatcctgagaaagacgtatacacccacaatgacacttttccacctgcccacacccaggtcctgttttacaaggttggtatgtttaagtgtattttactttgcagttgttcagaaggattgcatatttttgaaaaactacttcctgaaagaggatgactgtttggaaaggaaagaaaaatcctagctggctttggtggtaacagttgggaggcatacccacgtgagctttggtggtaacaattcctgaagcttctccaagggtccacgtgttcctgctgttggttgccagaagccagaataataatggagctgagaatatgggatttttgtgagaaattccaggggcattcagatttcacagcagaagcagatgactcagatgtcctgcgccttagagagatgcgtgaatcccttacctttaccatactctgaattggtcaacggcagaatggaagccctacaaaaattgaaaagttggttgcatgctaacattcatagtggaactgagttgaaaattttatccttgtatttccagactctctgattagattgttttagctatgctctcacccccaattctgagaacttttcaactgtgactgaggtgtggatgggtcaagcatctttacaatgtgacaaaatccccatttctcctctgatttactactaatggggagataattcattactgtgaagtgagcctttaatagattaaaaaagttgtaagaatatgtcacatagggcaggacctaacagggctgggcactttattgaggtgaccttatttaataatatcattagttatcatttattggactctgaactgagctcccaacacggaagatgtaagatttatctgcattttacagatgagaagacagaggcaccaagcagtataactagcccaaggtcacacggctgatatgcaatggagccaggattagatttgggccatttgacctttactgcctggtaaaagccctgaaaactaggaaggtgatattattcctgttttacgattgggcaaactgtggcttagagaggtgtattagtctgttttcacactgctataaagaaatacctgtgactgggtaacttgtaaaggaaagaggtttaattgactcacagttctgcatggctagggaggcctcaggaaactgaaaatcatggcggaaggggaaggaggcatgtcttacatggcagcaggtgagagagagtgagcaagagcagggcaaactgccttataaaaccatcaaatctcttgagaactcattcactatcacgagaacagcatgggggaagaatgcccccatgatctaatcacctcccatgacgttcttccctcaacacgtggggattatggggattacaatttgagaattctgccactgaaccacccatgcggggattagaatttgagatgagatttgggtggagacagagccaaaccataacaacaggttaagtaatttacccatattcacacaattagagacctataaagataccttccagagtagtattgtccgatagaaatataatgtgagtcacaaatgcaagtcacatgtgattttatgttttctaggagccacactttaaaaagtaaacgtgtcagcagttgggatgatatattttatctaccccaatatatccaaaatactgttatttctacatgtaatcaatgtagaaaacttacccatgaggcattttctcttttttctttcttactaagtctttcaaatgtggtgcatatcttaaacttgcaacccttctccatttggaccagccacattgcaatacccagtagcctcgtgggactactgaaaagtacaattctagagtggtggttctcaacccttgctgtgcagtggaattactagggagcttataaaacacagatgcctgaggcccattctcagagattctcatggaattgatctggggtgctgcttgggtgttaggatttttgtttgtttgtttgcttgttttttgagacagagtcttgctctgttgcccaggctgtagtgcagtggtgtgatctcggctcactgcaacctctgcctcccaggttcaagcgattctcgtccctcaacctcccgagtagctgggattacaggtgtgtgccaccatgcctggctaatttttgtatttttagtaaagacggggtttcaccatgttggacaggctggtctcgaacccctgacctcaagtgatccgcctaccttggcctcctaaagtgctgggattacaggcgtgagccactgcacctggctagatgtgaggatttttaacgacctccctcccgaccaggcagtgcccaaactaactgagtagaaaactgtagcctttgtacattagagaagtttctgtgagttttctgagatgagaaccattcagaatgactgctctggcagtatgctttgctagttgacattaatgaatgccaagcaatgcccaactaatttattaatttctctccatttacatttcccaacatgttgaccaagtctccagaataatataagaaaagagattttctttctcttgctgatttacacattggtctggatacataccagtgaaagtaaattcagacataaaattctactcttttaattgaggtcaaaggtgttggtgtcagcctggaatctctgagctgtggagaagaggaagttggggtttgaaagctgcaggtggctgccagaatgagacaagtctagtggggaatgcgtgggaggtgctgggtgaagaaaggaggcaattgtgtttcgcctgaggtctgaaggctgcatagcccgctgtgtctcaggacgttcacaaagctgccctcaccagaagcgtcgcgtccaccttcccactggaccaaatttttgattctgcccctgaaccctggatatgaaacccaatactgaagaattaaaatgtctcatctcacccggaggttcagttgtccttaaaatgcttttggattcatttggaataatttctatattggcttctttcatttaaatccaaatatagcttcagtatttctgacatatttattactttccagaatggaaatactagttcttctgaagtggtagctatttagttatagtcaattttgttagttatgtttatttgacttcaaattaagccagagaatatgcaaacactgcagtgtcttccacagccttaccaaaatgaataccatatttcatcaaatcaaaaatattgtcaactgtaagatgcaccattgtttcacatgagctaagaaagagtaagctattacatgacgcttttttatcacttggaattttattttgtgttcattgaagttcttttagcctgacttagacataactgtttaaaaatattttaacttttattataggtttaggggtacctatgcaggtttgttacgtaggtaaacttgtgacttgggggtttggtgtacagattatttagtcactagacactaagcatagtacctgatgtttgttttttttctgaacctctcccctcttcccaccctccaccctcaagtaggccccagtatctgttgttcccctctttctgtccatgtgttctctcattatttagctcgcatttataagtgagagcatgcagtatttggttttctgttcctgcattagtttgttgagaataatggcctccagctccatctatgttcctgcaaaggatgatctcattcttttttatggctgcatagtattccgtggtatgtgtaccacgttttctttatgtagttccagaaagttctcaggcgatgcccatgctgctggtttggggaccacacattcaatagctaggctttagtgtgtctaaggacatagtatgtcactgaagaaattcagtacctctccagggtacatggatgttttaatttttcttccatttgtattattattttgatgaaaatgtatatattgcaaatttgtttgccttgcattgggtaaatgcaaaggaagaaagcaggaattttgtatgtctgatcttatggtacagggagagagatttttttccccttaatttgtttcatgaaagatttgttcatttccttttcctttgctttctttatccaacttgggaaacttgaatttattaggaaatctgcatgtaattgcagattaataacctacccattaataccacattagttcatcatgattaatagcatctatgtgaatacttaatgaatttgtaatgatggactatttgctttaaagcgtcaagagaacattccatgtaaaaaggcactacccgtaacaggaaaattaattatatgctggttggataatagcttgtcacaaagaagatatgtttgtttggaaagcctcattggtattgatatttgcagtgagaggtactttttttaaaacattcatgaaccttttaatttgtaaaatgagaaggaaattttattttcatgaacagttaaaataggtgtagggactgatatttatgaaagagagcagcacaaacacaaatatgtgctaatatactcataagtttacctatgtcactaggcagaaagacttcctatagtggccatttagattaagttccgaattgaactgcttctactacccactggtctatcctaaattcacaagttcacttctttaaggctcaagcattttttttttcttttgagacagagtcttgctctttcaccaggctggagtgctgtggcatgatctcggctcactgcaagctccgactccctggttcaagcgattctcctgcctcagcctcccaagtagctgggattacaggcatgtgccaccacgcccagataatttttgtatttttagtagagatggggtttcactatgttggccaggatggtcttgaactcctgacctcgtgatccgcctgcctcggcctcccaaattgctgggattacagacgtgagccaccgcgcccggccggcccaagcatttcttgatactcattttatttcttcagagaatcatttgttttctctactgtcttcactctaattctgtgatgtcagcagtcatcattgtttatttctgtctttgccctatatctgaggaagtgaaggtcaagaagattatgtgacttgcccaaaccaatccagccatataatttgttcgccacagattatgggtctctcatttcaaatgtctccagttttaaccccggcggaaagagttgcaagcgcagagactctgtccagctggtgcctttgaggaaacccaagaagcccagtgtgattggagctctgagttggaagggaagaggcataaatgataaaactgaggagaaaggcgggggccagagcatacaggctttgtaggccgtgtaaagattttagactctatcctagggcaatgggaaggcgtttgtaaatgtcatgttgagggatgtaatgagcgatatgttttgccagagcttgctgctgtctgtggagagtggcttggaggaggtagctgacaaatggcgaccaattcatgctttacaggccccatcatgttgatctattttctagtctggtatccaaacgaaggtggagtttgacttccttgttacagaaaataccaaggcatgattgtttatccttttctctattttctccttaggtcaacatgaaagatcattgcttcttctttgttgcccttgatttctttgaacttaggaaggtattttgtcaagcacccccactcatggggcaaaatctgccagggaagtcatggcagctactggtgggcatggtagttagtactcgttctaccagcacttttgcccctttgggttcactgcttgtgccaaaggtgctgttgcttccccccttttgggggagaggattctggatagagaaggaaagaaagccttacccctaatcactcactgtcggaaacccagttctggaggagcagtctccctcgaccacacattgtggtttgaacagccaggaatagaacccctccttctctcacctcctcatagaaggtgggagtgaaaacaggggttagttgggaagtggctttttaaacctatgtttacagtgttttgatgtcactttcatagacgagggaggaattgtctgaagctcagattttttaggatttcagggatgtgatgtttatctctctcttcctctcttgaggatgtggtataaactggaattgaaaatagatacccggctgggcgtggtggctcatgcatgtaatcccaacacgttgggaggttgaggtgggtggattgcttgagcccaggagttcaagaccagcctgggcagtatggcgaaacctcatctctactaaaaataaaaattaaccaggcactgaggcacatgcctgtggtcccagctactcagaaggctaaggcaggagaattgcttgagcccaagaggcggaagttgcagtgagccaagatcgcgccactgcactccagcccaggcaacagagtgaggccctgtctcgaaaaaaaaaaaaagaaagaaataccctgtatggtattctttctttcactttgagagtctttctggcatagtgctaatatttttttccactcttgaatctgtgaatcaaccctcacatcaaacccctattgcattttatgtttaagaagggaactttttaaagctgaggttggcagaactgagaaacttagacctaaatgggcctatgcaaggagggtgtttccaaaacaaaacaaagtgtttagtgtcctccttgaagaatgttgacactgagttaaaatggagctgcagagtgaggaaatcagtaaagacaggacaaaagttccttttttgatttgaggtagggtaggaaaggcagaggtgggattctgggctggtgatgtttccagggattgcaggcatcaagaaagaccggtgagtgctgttggtttaaagtagttgttctcaaagtgtattcccccgatctgcagcatcaacattacctggcagtttgttagtaatgcaaaatcctgggtcccaccccagacctactgaattagacactcaagttaaaacacagccatttgtgttttaacaagctcccattttttttttttttttaaatttttgagacggagtttcactcttgttgcctaggctggagtgcaatggcacggtcttggctcactgcaacctcaaccttccaggttcaagtgattctcctgactcagcctcccgagtagctaggattacaggcatccaccaccatgcccagctaattttttttttgtaattttagtagagatggggttttaccatgttggccaggctggtctcgaactcctgacctcaggtgatccgcctgcctctacctcccacagtgccgagattacaggcgtgagccaccgcgcctggcctaacaagctctctttattattccaatgttcactcaagtttagaaaccactggcttagactagagcaaaatgtgaggtcaagccttgaggaccagccaactttgttctgttctaacctcaccaggcctcctacctctggttaggtgccccaggagtctgtgtccctggtcaaaaatagggtgacagggcaaagggagtagatggctcatcacaaagacattgcaccactgcaaaaagaagttatgatgtaaccagggaaggtctttccttcagttatggtggagagatctgtcagggaattccatgagggcatagctgcctctcatttagccactgggggcccattctctcacaggaaagcaacttgcagaatttttctgggtatctgatgtttgaattaacaggagtcagagacctgagtccaaatcctagctctaacctttactaactgagtctccttggacaagttcttatagttttcttgcctgcacaatggagttatgatatatgtttcttaggattgctgggcaggttaattgaggttatgtattaatacaatacatctggcacagagcaggtgcttaaaaaatgaacactgtcgttactggtccttggatgtcttaggattgttcaggaacgaccattgcagggagtatataaacatacacggctttttccttgtaacgttaagatggataaaataggaggcagaggccaggtgtgctggctcacatctgtaaccccagcactttgggaggccgaggcaggcagatcacttgaggtcaggagtttgagaccagcctggccaatgtggtgaaaccccgactctactaaaaacatacaaaaaaattagctgggcgtggtagcacgtgcctgtaatcccagctattcatgagggtgaggcaaagaatcgcttgaacccgggaggcagaggttgcagtgagctgagatcatgccactgcactccagcctgggtgacagagtgagactgtctcaaataggagggagaaaaaatataaataattagagttagtagtaaaaatgctatacgaaaaaactgaggatagatttattttaaacctcaagtttggcacagaccttacatggaattatctgctaagatacaaaatatctaaataggaaagctatttatattgagttaaaacataagattggcagattcattgtaatgctatgctatcaaagaataatgctaaaattgaaattattttgaagtataaccttgataataagtataattcttataaattcacttataagtgaacataataaaagagttatcttctgttagagttttgtagtatctggcaattttatataattaatttcattatggacaaggaggtcttttgtgttaacagggacatttttgtgttatttggtaacccatgatttagaatgatttagaggattttaatccccttaaaatcatctctgcacctttttcttaagctgatgctaaccaacaattatcatttataagatcataaaaaatgaacagagaaaataattctgacagcttctatccctatatttaggtgggagttttctagaggaatgagaaagatcagctcctattggcttttcagtatgtcatacagattcagttaatcccatgcttgactggccgtgaggctgaggaactgccaagctgagtgtcacacaattcgtgtgaaaatatatgagagttacgggatccacggaccatgacttagttaacttgaattttattttttaatgagaataacaataagctttgcaagcttatttagagtctgcagctttaagtgcataagggtttaatacctttaatacccatgcagtgtgagttagaaaaatgaaaattttcagtatagtaaataaactgaggagcctggaaaccaaattgaaatctgtagcctagaaaatcaacaagagctaaaaatagtaggattagaggcagcattcaaccatagaccatccaaaggtagtttttaagtaccaccaaaggagaaagcaggccattctataataagttttaaaaaaaatctaggtctagagaacattctgttcattatgtagatgtggaagcttaaagtatagatttggttttccagagttttaatttttcatgttctttttttcaccagaatcagagggcactccctctgatttccaaaagagaaatgttaccacaatctgcatgaaattgagaatttaccttgctgacactgacgtgaagattttagaatgcagttgctggccaggtgtagtggctcatgcctgtaatcccagcactatgggaggctgagttaggaggatcacttgagactaggaattgaagaccagcctgggcaatatagcgagaccccatctctacaaaaataaaaataaaacaattagccacggtgtggtggtgtgcacctgtagtcctagctacttgggaggctgaggtgagaggatggcttgggcccaggaggttgaggattcagtgagctgtgattatgcctctgttctccagtctgggtgacagcacaagaccctgtctctaaaagtacccattaagcaaatcaagcaagtggctccaggattcactggtctcttagcaaagagccagaggccccctttcagaataggcacatggaaatattgcagggtcaggagaaagaacccaaaggagggtgtttttaagtgttcctgtgctcctgagccacttcattcaaatgtcagctcaatcaaggttcttggtaggtttttgctcataggcctaaaactttgcatgtgtggagtttttgaaaaatgttttaggtggatatgtcttagatattgtagaaactttaaatgattggcctgagctgcagatggctgttatgaactcttgactaagcatggtactgtaaaatcctcaagggcctcatccttcctttggaatttcctttttgtattctagagcactcaataaatgtcctgtctgagcagcagaattgaattgagtgaggattgatagtcctctctcagcttccgagcagaactaagtattttttttctccccagtgtagaagagcagggcattgggaatggatgataaagctgagacaattgatgaaaataaaacttaggtacccttaaaactggcgttcatgaaaacagatgaatgaagtcttggatttcattgtatgatatagggactgagatgtgaaaaaaagagatggtgttgttagtatgatcagggcattgctgattgtaaaaagaaataataaaagtagtcagtccagcttctcatagttctttttcaattggatgaaagtctctctcagactttccttgtcaggaattcaactcagcgaacattcactaagcaccagccatgccaagctctgggtcctgggtgttcaaagatgaatgtgacccagcccctgcccaaaagagtattcaatctaatggagcatagccattgttaatgccaatgttttataccaaaagtatttcttggtgatattatttgaggcccaatgaccaaaaatatctttattattaaaattctcacgtttcatcccctttgaggctaggcttgggttacaaaggcatggttgtccacaccatggtcaaaaacaaattttagatggactgtagatctaaatgtgaaacaataaagattttagaagaaaatgtaaactgtcaccgggcgcggtggctcatgcctgtaatcccagcactttgggaggccgaggcgggtggatcacctgaggtcaggagttcgagatcagcctgaccaacatggtgaaaccccgtctctactaaaaatacaggctgggcgcggtggctcatgcctgtaatcccagcactttgggaggctgaggcgggtggatcacctgaagtcaggagttcgagaccagcctggctaacatggtgaaaccccacctctactaataatacaaaaagttagctgggcatggtggcgcatgcctgtagtctcagctacttgtgaggatgagtcaggagaatcgcttgaacctgggaggcggaggttgcagtgagctgagatcctgccactgcactccagcctggcgacagagcgagactccatctcaaaacaaacaaacacacaaaaacaaaaaacaaaaaatagctgggcatggtgacatgtgtctgtaatcccagctacttgagaggctgaggtaggagaatcgcgtgaacctgggaggtggagattgccgtgagccgagatcaagccactgcactccagcctgggcggtagagcaagactccatctcaaaaaaaaagaaaaataaaataaaatgtagactatcttcatgagtttgggataggcagagatttcttgaacgggacactaaatatggtaaccatggaggagaaaaatggagaagctgaactaaaataatttcagtttattacaagataccattaaaaatgaagtctatgtaatgggatattttataatatattcaaaaaggactcgtacgtagaatatagaaagcacttctacaaatcaataacaaaaaggtagattgctctataaatatgtgatatagacttgaataagtattttaccatagaggatgttaattttcttgcttggggttagtgattggaagggagcacaaggggcttttggggttccagtaataatgctggttacttgagcgtgttaactttgtgaacattcttcacattatgatctgtgtacttttctgtatgttgtattatttgtgtacttttctgtactttcattggaaaaatttacataaaaaaagaaaatgctttgctgtccaggatgaagaatgtgagcagaatatttttggaggttaacactgattgcaaaatatgtcttcccatttagaattgcctctactatagaagcagaggaaatgttgagagcatggggctttgcaaggtggctatagcaggtgcagtttgtgaaatagtcctacacacagcctggcagtgtcttaggttagcataagtcctttggccaacaatatcctgagaagcaagcaggagaacaaacacagttatggaggaagcactagaaacaagcttgattacttgacagttttgtatagggcgaattctgcctgtaatcctgtttaagtcaccacttactgatccccgttatcatgtgcccaggcaccaagatgggggctttctgtgtattaaaaattttaaatcctcagcacaatcctgggaagcatgtactattattatttgactttacagataaagaaactggggcttagagggattaaataactcgctcgaattccagctagcaagttgcagcaagctgcaactggaacccatgtctgtgtgattccaaagcacccccttcccacatgtctattatgttgcctttaaaaaaaagttatttgatggagcatagtgagaagaaaaatacttaatatgtacttaatgttcaaatttgatgatcagaagaacttctcaaaccacttttaaagtctgaggtttgctgtgctatagtttttttttttttttttttttttttttggaaacacactttgtcgcccacgctggagtgtagtggcgagatcttggctcactgcaacctctgcctcctgggttcaagcgattctcctgcctcagcctcccgagtagctgggactacaggtgtgcgccaccatacccggctaatttttgtattattagtagaggtggggtttcaccacattggccaggctggtctcaaactcctgaccttgtgatctgcccgcctcggcctcccaaagtgctgggattgcaggcatgagccaccgcgcctggcctgcagttttatgaactgctattgtcctttgcagttgtaaggtggtaagaaatacctgggtggggtggaggtggggattgagaaatcctccaagaaacaacacaggctatgattggaatgcccctgtatgggtgacccatgagcctttctcaatgctttggggacattttaataacctgagtaattacctgtggtacgcaggctttgttttctactcattaataactctccaggctacattttattcttcttactgctaattcacatgcagagatacataaaatggatgctgtcaactgattgccacatcactgtctgcatatcaatgctctcctgtctgcttgggctcagagagaaggaaagaagagaaggaaaagggtatggcaaggaacttgtgatagccgaatctgttttaaaagccaaattctggtacagaaaccagaattttgacatatacaaattattgatatttgtgcatggttagtgttttgggattgccctatttagcatctgctgatcctctttttccctccctgtgatagatagcatgccttggaagcagacacaggtaaatatttaatgcttttagttttttttgctcctgtggcttgtttggcccttagggcattcatgttttttagcctgtggagtgcttatagcatcagaacatcatcacaaccctaaatgaaatttggattatttacttctaagtatgtttcccaaatagtctaatgactgtgtaagcaatatagtggaagggtacaggagccgatttgaatggaaatatatgtggatatggctttagatctttctgcgtattaaaaaaaaatctcctttaaaaaatccttggggacctggcacggtggcagtggctcatgcctgtaatcccagcactttgggaggccaaggcaggtggatcacctgaggtcaggcgtttgagaccagcctggccgacatggtgaaactccatctctactaaaaatacaaaaaattagccgagtgtggtggtgtgcacctgtaatctcagctactcgggaggctgagacaggagaattgcttgaacacgggaggcagaggctgcagtgagctgagatcctgccactgcactccagcttgggtgacagagtgatactctgtttcaaaaaaaaaaaaaaatccttggggctagttatcttgattttattattatgatgatacacaagaaagaaaacaccaaacaagctgaaataattgaaaatactcacatccaacccaatttaatttatttcactggaatctatctagttatatggacttgttttaggtacaggtacttatttttaaaaaactagacaggagctctgggttgctttttttttttttttttttttgaactgtagaacttctggtttagaagtaagattcctcttcaggagatatacaattatttattaacttaattagtgccgtacattttgtcttgaagctattcagagtattataggaacatctgttgtactgtgattatgatggctgctaggctgtttccccaaatgccttgacaaggcagtttgacatagttcggtgaaggcagtgccctggtgctgcagtcaccatagggatttttcatcttggcttcatgttggtagattgatactctcaagtacgttcaaggttctctttttcgggagagggttgttttcattgagtcctggctttcctctttccttatttaatgaaatagtgacaactatcattttctaccttcaaacattattattagtgattttataaatagaaaattattttccaggtgggcctatgtctgtgctggcaaccattgtgtacacacggactctcttagatgtttaggactttgcatgtgtaaacgggcaagttttcaggcaattcgggtaggttttccaatcttgtctttccatttcctgtctaaagaacttcttccatgtccacagcatgtttattcaacaatggataaaacttctaatgggaaatttcttccgggtgacctccttgagaggctgggctgtggagaaatcttaagaaacacaaccctgatgaaattggctccgttgagaatattacttggtccaggaacaagggacagaattcagttatttttggttcttgaataaatgaattctgtttccttttgtgtaggtggcagaagaaattaacccctgtagaacatccattctcagttggaaattaaatttttggtttcttttgagttaggagtaccctggataagagaatgtaaaactgtttttatttgaacctcatgcaacttggaatctgttctgttgtctgcatatctttgatagatttgtcttttccagggttgtctgtctttgtatttaattttctggaggttggaattgtgattatcaaatgacttccaacttggcaccatatgtgggtggatactaatgaatcctttcttaaccttcccagaacttttggagaaatcaatcagtagaaggcgggacaccgaagccatacagaaagccaaaatcctttattcatcctgcatgaatgagagtgagtgatgaagaaaactaaataaaatatttaccatccctatcctttagagttctattaatgttttaatatattgtttgaggaagaagagaactactaagaattctattaatgtttaaaggtgttaaaggaatgattgtgaaagactggattttgactagtcccatcttagttaatgttgttactggcttggtggagaaaatcttatttatatgagttggattctttgggtatcatttactccctgagaaacttagacaaagtcagcagggcaaactccactgtatctggtagagaatccagaagccaggccaagtctggcttgagacagagactgggagggagtgcacctactggagcctagagaaatccagattcccaggcatgccaggttcctgtgtcagcctaacaggcatctttgttgggtccttagccctgtctcaatatcttgggtctgattggaatcagaacagatactggccacttgacctggtctgccttctcaagcccaccacaggaagaagccagtgcctgtgggaagtgtgtcaactggtctaggatttggggtatcatgtggtgagctagaaaagagcaataaaagacaggaatctgaagcatcacttcttcttcattgggtagtgattggctttattgaggcattcctttagttagggttgtaacttagtcccaccaagtattattcattggctgggttccatgtagagaatccatgtttattgtagtgaatatccagcagtttccctggtcagctctcctggcaagaacactaggtatagacagtcacattgaagcgtggatcgtaggtagttctgtctctgtgattatgctcatcccaccccacctcttttacctactccctaacagctgaaattttaagttggagcattatgggaattttgtcttgagaagatgcacttaaattctagtgtgctgatccagtttgcaattctaactttctcttcatatctgctccctttcagaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaaggtataatgaggacccattcatcttctttgctcagtcctagattagccttttggggtgccatcctggggaaagagactcatgctgccttagtgaaataataacataaaacacttttattgaatagtagaatccagaatattcccttctcccggctttgcagaatgtagaccattaccatacaagttttgtaagccttttggaaaactagtgaattagtttcaagtgatctgtgatctggccctcatatgcctactcagagcaagcctagggttcctaaattccagtgggaaggggactgcaggtctcctgttgttagcagagattttctgagccctgctcttgtccttgcctcctcactcccttgatagaggagaaaacacgtgccatgattttttgttcctctttcactaacattttcttgtgcacacacctaaattttagttatcaacttcactctgaatctctcctccctcctttccaaagatacagcaaaacttgttctgttccaagtgcttggttgcgttttctgttggaagactaaccatgtctcccataaagcaatgggccacatggacataccctgaggcatttcacactggtaaaatcaggaggctgtcagaaaactaccaacagctaaagactcaccaatgaaagagctatgcaagaattcaaataacattcgtcaaatagttttgtgctttgatcctgctgggttttgttttgttttgcttccacagttactttgactaataatgaaaatgttattgcatgactgattttctccccaattctgtccttagtcaaatcagaaaatattaatgaaatattgatattcaaattgtagacatgtattgccctcacctcatgcattttaaccttctaaaatccaaatcttaaagttcatcgtttgattgaagctggtcatcgtttgatcagagattggcacattttttgggtaaagggccagataatacatattttagggtttgcaggccgtctggtctctgttgcaactacttaattctgccattgtgtctgggaaagcaactgcagacaacaaaggtatggctgtatggcgggctggcccagtggctgtagttttctcacctctaggttagacaatggaattctcagtaaaaatctttggtcattgaaaggactcccctctactcaggaggaaattctgagttccagagacaactgtgtttctatgtttggtgatgaaatgagccatcttctaatgctatcaggataagatgtgctatgtaagacacaatgatgatgacgacccaactgatctctgtactgtgttgatatatcactcattttttgaaactaggttttaagactatcattatcagttccagaactattatgatgttctttcaaacaccttaagttggtgttttgaagtaagctgaaggctgttttccaaacttaagtttaagtttatacattctattgagtgatagaagatcttgattcacacacagatgaataattgcaaacggtagccattttattatctttctcacctatttctggatctattcaattgaatttattgctttaaactttttattattaaaatgtggtacaaaattaaagaatagaaaaataaactcccatgtatccatcaacccagcttcaacaactctcaaccttctgatgttatgtttctttctgcagttatgttttaatctagagccctccttttttgggaggtggctagaacattttatagcaaattaaaaatatatcattgcatagtaaatacttcagtgcttagctagtggaaaggactattatcacaaccaaaaagataatcataattccataattaacatctaataactagttaattttcaatttttctgattgtcttaaacatgtccttaaaaaaaaaaacagttggtctttgattcaatctccaaataaaaatcacaggtgaacttagttgatatgtctgttttactccacaagggatccccctatttttgttttttaaaccacatttatttgttgaagaaactggagtatttgtcctgtaaactgtcttacattctgaatttgactgttttcagggtaatctaatagctgatgaaagttcttgtttataggagaatcacagcttaaaaatgcagaagaaataataggaagctatctatttaaaaaaaaatccctaaggaaaggattgatctaggcaattatcatcaatggctgctaaaaccattaggtaaatggttgattgggaaattcatgatatcagaccgatatcacctgaaccctaatatcaatgatagcattgctaaaagtggggcaaccagatattgtgtgcctcctggtatcagtaggaagtgcacactatcaccagtgatgttgtcgtgcccccacaattgagcctctagttttaagaggagcttacagaaaacatggggaatagagaaacatggtaaccaatttttaatagcttgccttgtatacttaatattcaattaaactgatcctagaaacactaaaatgtcaatgatagaatactttccaaatgtaaggaggcacccatgtacttattattgctctcttttgtcaagatggcagcttgttccaaactggtgtttgaacattgtttggcatttgagtgcggcaaacgtttgcttaagttctgttcctgtttgtacctttttccatgactgaatattcacacatctgaactaattgccttccctcagatataatataattatagtcttcctgatgacacatttacaagagttcgagcatgtatctggaggtggtaggagaagttttattctgagagctgcatgaaacccattgaacctgataacaaaaattagcgtactggtggctgccaaagttgtagaatttgcaagtgttgcttttttattcatttaaaaatagttaaaactataaaagacaaaatctaattggatgaacatttgaagccccccccacttataggttttgtggaacatagtttgaaaactactggtatagttaaaaaacaaacaaaaaaaataataggctttggtatttaaaagattgaggtttgcagtttagctttgtgatgtactcaccgaatatcctcgtgcaaattacttcacctcgctgatttcacttttcccatgtgtacggaagggtgaattagaatttacttttaatcgtcattgacgttcaaatgaattgacttttgtgacagttttcactgtagatactggtccacagtagcacacgacacaaggttccgaacctactcttcaagcatgacccagcaactggtcaggaccatttggagaatgtttttctttgacatgtggtacccgatatgcctctcagagctcaaactcagtagtgcaaggaataggaattttgtttactcaacctaatatttgacttttagctcccacccaaccttttggtgggaaactgaaccttagtctaggcatttacctcccctcttggtggccccatttctcggtcttttcctagggtattgggaaactgcaataaccagttatctggtttctgagaagaaacccactatggaaccatgtagcctcttcaagtgtgcccctctgatgctgaggtcctgcgactcccattccttctcagatcctgccatgttttggggtgatcagttcctctgctcatgagaattcttgacttcttttgctgcttgaaagatcctctttctgctctgggagaaatccctcttacctgaaactctcttccctcaatgtcgttaggcttccttttccatcgaattcaattttcttcggtgtgcttagcttttctaatcccacaaacccacaggaataagagaagggccttttgggcaggcacagcactgtgggcatccttttgggtgagcagatggtgcctttgggtgaagagacaggcaccctttctaagggttagatatatccccatgccaaagacatgcagtttggccagcaggggtcgctctaatctacacagcgtacttctgcaaagctcccctgtggcaaaatgatacagggtttgctacaggcttaaatgaggtaaaggaattccaaaaataaagaaaacaacagaagttagtgaccaaaaacattatcttgctgcacacgtttggatttattctatgtcaggagatagtatgaggatttaagggacaataaaagacgtgagtatatgtgatcctgaaagagtatttggaaggccaaggatgtcccagtatgtattactagttaatgaagacaacaacttaaagtcatcatctcacaacagcctgcatttttctggctctcagcaaaactcgtaaaaaatggcaaggagaaactccaagaaaatttgaaaagtttcattctctttccttttcctttttttctcaggaactgacagaacatagaattttattttattattgttattttttattgatacgtaactacacattttcatggtacatgtgataatctgatacattcatataatcaaatcatggtaactgggatatatccaataatgggattgctgggtcaaatggtagttctgttttaagttttttcagaaatcaccaaactgctttccacagtggctggactaatttacattcccaccagcagtgtataagagtttctttttccttatatccatgccaacatctattatttattgactttttgataataaccattctgactggtgtgagatggtatctcattgtggctttgattcacatttctctaccgattagtgatggtgagctttttttcatatgcttgttggtcacacgtatgtcttcttttgaaaagtgtctgtttatgtcctttgtctactttttaatggggttgtttggtttttgcttataaatttgtttatgttccttgtaaattctggatattagacctttgtcggatgcacagtttccaaatactttctgccgttctgtgggttgtctgtttattctgttgatagcttcttttgctgtgcagaagctctttggtttaattaagtcccgtttgtcattttttgtttttgttgcaattgttttgggcatcttcatcatggaatcttgcccaaagtaatttacagattcaatgctatttctatcaaactaccaatgacattgttcacagaattagaaaaaggctattctaaaattcatatggaatcaaaacagagcccgaatagccaaagcaatcctaagcaaaaagaacaaagctggaggcatcacattacccgatttcaaactatagtataaggctgtagtaacaaaaacagtgtggccggtacaactacggatacatagatcaatggaagcagcccagaaataaagctgcacaccaacaaccatctgatctttgataaagtctacaaaaacaagcaatgggtaaaggactgtggtgctgggataactggctagccatatgcagaagattgaaactggacccatcccttttatcatatacaaaaatcaactcaagatggattaaagatgtaaatgtaaaacctaaaactgtgaaaacccttgaagaaaacctaggaaataccattccagacataggccctgtactatattttgaagtcaggtaatgtgattctccagctttgttatttttgcccaggatcgctttggctatttggggtctttcgtggttccatataaaatttaggatttgttttttctattttgtgaggaatgtcaatggtattttgatagaggttgtgttgaatctgtaaattgctttcagtggtattgtcattttaacaatattctactaattcataagcatggagtatccttccatttttttgtgtccttttcaacttctttcatcaacattttatagttttctttacatgaatcttttatttcatgggttaaattgattcctaggtgttttatattgtaaatgatattgtttattgatttctttttcagattatttgcttttggtgtatacaatgctgttgattttgtatactcgaactttactacatttgttgatcagttctaatagttttttggtagagcctttaggtttatccaaatataagatcatgttatctctgtacaaggctaatttgacttcttcctttccagtttggatgccctttatttatttctcttgcctaattgctctggccaggacttctagtattgcgctgaataaaagaggacaaaacaggcatccttgtcttgttctacatcttaaaagaaaggcttttaatttttcaccattcggtatgatgttggttatgtgtttgtcagatatggcttttactttttgaggtgtgttccttctgtacccagtttgttgagggtttttgtcataaagggatgttgaattttattgaatgcttttacagaatgtattagaatgattatgtgatttttgttcctggttctgttaatgtgatgtgtttatatttatgtacttgaatttggattttccatttaatttattttttttgagatgggatctcactatgctgcccaggctggacttgggttcaagtgatcatctagcctcagcctcctgagtagctggtactacaggtgcatgccactgcacccagcatatcatgtctattgatttgtgtatgttgaactatcctggcatccctggattaatcccactcaatcatagtgaatgatctttttcatgtattgttgaattaggttagctagtattttgttgataatttttgcatctatgttcctaagtcatattggctggtagttttcttttctccttgtgtccttgtgcagttttggtatcggggtaatgctggactcatagaatgagtttggaagtattcccttctcttcagtttttttttttttttttttggaagagtttgaatataatttgtattgcttctttaaatgttttgtagaatttggtagtgaagacatcaagtcctgggcttttctttgatgggagaccttttattatggcttcaatcttgctactaggtattagtttgttgaggttttctacttcttcatggttcaatgttggtaggttgcatatgtccaggaatttattcatttcttctagatgttccactttgttggcatatagctgttcataatagtctttataattctttgtatttctgtggtctcagttgtgtcttctttttcatttctgattttatttatttgtgtcttctctcttttattgttagtctagctaaagatttgttgattttcaaaaaaaaagccaacttttttcattaattttttttggtgtttttatagtctacatttcatttatttctattttaatctttattatctctgtctactaatttggggtttggtttgttcttatttttctagttccttgagttgtatcattagattgtttatgaattgttatttgaagtctttcaacctttttgatgtaggcttttattgctataaaattccttttcagtactcctttggctgtgtttcatagattttaatatgttgtaatttcattttcatttgtttaaagaaatttttaaatttcatttttatttttttcattgacccattggtcattcaggagcatattgtttaatttccacgtgtttggccaggcatggtggctcatgcctgtaatcccagcactatgggaggtcgaggcaggtggatcacctgaggtcaggggtttgagaccagcctgaccaacatggtgaaactctgtctctactaaaaatacaaaaattagccaggcatggtgtcgggtacctgtaatcccacctactcgggaggctgaggtgggagaattgcttgaacctgggaggtggaggttgcagtgagctgagatcatgccactgcactccagcctgggcaacaaagcgagactccatctcaaaaaaaaaaaaaaaaagattccatgtgtttgtgtattttccaagtttcctcttattattgatttttagttccattgtggtcagaaaagataactgatatgatttctgcttctttgaatttgtggagacttactttgtggcttaaaatatgatctatcctggagaatgttccacatggtgataaaaagaatatgtattctgcagcaattgggtgaaatgttctgtaaatgtcagttaggcctatttggcttagtgtctagtttaacgctgatgtttctttgttgattgtctagatgatctatccattagagtggagtgttgaagttccctatcattactgtattgcagtctccctctccctttagatctgttaatatttgctttatatacttaggtgctccagtgttgggtgcataggtatttataattgagataggcagtatattgctatatctccactaggtccttgcctttttttctggcactaaatggcaccttaagcctacgtttgctttgactctagcccaagatcagagcactcccagtccagatataggggaggtcctaaagaggatatcctggcagtgtggaaaagctggctggcggctagtgtacaggtgacctttggaatgaacctcctatagcataatgctgctgaacagccactctgatttggtgtctcctttggccgagttacggagcagagtttccagggctgggtatggtagtcccacctcccctctttgtctcttgctgtcttcagaaatatatctcccttcaggcactcatgatgccttctgtgggttaaggtatgggcaggtcttctgtcaaagaacccaagatggtcaggaagctggttgtccaccttgatctcactttttccagtgtagaaactatgagtcagggaaaatttctgcaggcttgttgctggacagattggttggaagggcatcatagagaaattttattatcctttgtctgcttggagttttttcacttctctgtggcctcagcaactgattcatccttatatttgagttctgggatattgctggtgagaatcttagtgctgtatatttgtttttagtttcctgtgtatatgttggggtggggagggaagccagcttctgtctccaccaccattttgaaacctgaagtccagactccatttcctacctcaaaatttgtaagctctttcttcttgtattactactttgtcttctaacttgaggtttattatcattggaatgccagttgtaattggagaaaacatttatattttcagttaaatgtgttggatttcctaaaaaacatactttattttctgcttacagtatttagatcagttgtaaatgcaaggatttaaaaaatctcaacgcagtgtcctgattgcttcatgagaaagtcttttgcctcaagagtttgtatgtttctaatgagatttatttgactgaccttattcaatttgttggttggtgtgtttaaaatgttccctagaaaccataacaatctgaaagtttataaaaggtctggtaacctcacttgaattatctaaacttttacaataagtggatttaactttatttcatgagagggaaactttggctttcttgataatatctacacagtttcctttcctatgagactcaagctcaaaagattcttcaagtggtccaaatttaattgaaagccaaagtgtcttaatcataatattgtgtttcatgatcgtggcttgcttaatttttggaagaaatagtggcagattgggaattgcagtaggacgaagccaggaaggcttgtgactttgttgtttcaggccaatgagagagggttgaacaaaataatttgaggattttagcagtatacacagacaagatgggtgttttgaaagtgccttttttcccctgaaacaagagttatgtttttcctggaatttttcataatatcactaattcttaacgtggcctttgtaaaatttgttgtatattaagggcagtttcatggaaaactgtaatcttatacaaatttatgtatttaagattatagtaagacgaaaaagaagctggaggagatgggtcaaaacagtttaaagtcatataaactaatggtatgggcatgtaggattcagtttttattcagatattactaatttttaatttgttgtttagattttgtttcttattattttggcttaatgtttaatgtgtgaattagagatttaatttggaaaaatctactcttcttgagattcattttatttatctttagtcagttgctgatattcaagaaagaacaaaccacagatttagagaaggtgctggaaatttttttaaagtatcttaaaatttacataaattcattttttgtgatgtacatgtctaagttttgacaaatgcatagagtcatgtaaccaccactgtaatcaagaaatagaatagtcccatcatccacccccaaatacctcatgttatccctttgctaagtcaagccctctcctcatgcccaaaccctgttagccatcactttgttccctgttcctgtaaagtttggctttttcaggatgtaagtaaaattcacccatgttgtatcagttcattctcttttattgttgagtagtattccattgtataccacagtttatgctttcatgaattggaggacatttgggttgtttccagttttgggtgatattgaataaaattacatacaggtttttgtgtgactttaaatttttttcctgggtaaatacctagaagtaggattgctggctcttgtgtaaatgtatgttgaactttataagaaactgtaaaattggtttccttccaaagtggctgtgccattttgcattcttaccagtaatacatgagtgatccaacttttccacgtccccaccagcagttgtcagatttttttttccattttaacagatctatggtagtgttttattgtgggtttaatttacattttcctaatgactaatgatgttgggcatattttcgtgttcttattttctatcttcatatgttctttgatgaagtgtctgttagaatcgtttgctcaattttaaattgagttgtttcttttcttatggttgagttttgaggaatctttatgtattctagatacacgtcctttgtcatatatgtgattttcagatattttccccattctgtggcttgtctttttattctgttaagtttctttcaagagcaaatttgttcaatgtcgataaagtctaatttattttttcttttaaggattgtgattttattgtcatgtctaaaaactctttgtctaacccctagtaacaaaaatttttcccaatattttttccagaagttttatagttttaggttttacatttagggctatgattcattttcagttaatttttgactaaggtgtgaggtatgtgtaaaggtttattttctttttgcttatggatgcccagtttttcttttctttgagatggagtcacactctgtcacccaggctggagtgcagtggcgccatcccagcttgctgcaacctccgcctcctgggttcaagtgattctcctgcctcagcttcccaagtagctagaattacaggtgcgtgccgccacacctggctcatttttgtatttttagtagagactgggttttaccgtgttggccaggctggccttgaattcctgacctcaagtgatctgcctgccttggcctcccaaagtgctgggattacaggcatgagccaccacacaaggcctggatgtccagtttttctaacacgctctttgaaaagactgtcttctttcttttgtttacctttaaggtgctgaaagttttttttgttttttttttgttttttttgtttttttttcctgagacagagttttgctctgttgcccaggctggagtgtagtggcgtgatctctgctcactgcagcctccatctcccaggttcaagcaattctcctgcctcagcctcctgagtagctgggattacagccacacgctaccatacctggctaatttttatattcttagtagagacggggtttcaccacgttggccagcctggtctcaaactcctgacctcaagtgacccacccaccttggcctcccaaagtgctgggattacaggtgtgagccaccacaccagcctaaggtgctgaaagttttaattcaagaatttatactatacttttctatcactgtaattctacttatttagttgtctggttattatttgtgtttttatcacttatcctaaaccttccagagagggttctaacatttgcgaaggtttctcaaaacaaaattattatttgattccattcaaataaaaaaaaatcaatgccatatgttattttagagataaggagttggaaacgtctgattaatcaactctatacagattggcattttgcaaaacactgcaatgagaaaaatactggaactggtgataggagacaacgattttagtctgagctctgcccaatcatgttaccttgggaaagtcacaacaattatctggcttttgtttctcctcccattgaataagggagaatagctaataatctctaagatctattccaactgaaatagccttgttgttattcagtgttgataggacctcaaaaggtttagaaaacataaattagaaaagcaggggcaggtctctgatagtttattatatctgtcattgccaaagtgcctatttgcatgtaattctgagtgtactgaattgtttttgtaatggtgacatgagctcaaaatatggctgggatgcagacgatttcatcactcttgttaacatggtacgtaagaatttacagtgctagcagaatgctttctgtttttgtttttacagctggaccaagcaacactctccctggccgtgagggaagactaccttgataacagtacagaagccaagtctgtaagttttactcatattcaactatgtgccttaccaggctgctgtcaggcccattagttctaaggccgctgcttctttattggaaatgagcagtgtggctattcaatgaccatattcccaatgcaggaagacttttattcaggcagataaattccactccctgtctttctagaagtctgctcatcaaggctgtacaagtctcagtactcaatgcccttatctagcttgggagacagcactcccaaatgaagtaacaaagaaatgagcttgcagtcattcattcctcagaagtgcagagagctcactatcaattgcagaaataaagcgtcagaagagatacccaggagacagatggttcccaaattgtactgctttagaatcacttgggaggctttcattaaatgttgcttcttgggtcacagccctggagagtctgacttagacttgaggtagggtctgagaatctatatttttaacaggtgttccaggttaatggaggtttaataagaatcagaaaggatcaatcaagttagacttcttggattggcttagaaatctagcagtctcctggatattggaaagagctggttcatttctgacactttcaatttattttggaaactttattgaacttccaaaggagcctcagacctaggtcccctgggtctatgccgatactaacttctatacatagaaggctctggagggaagctaactaagatgctgggcagctttcttgctgaggacactcaccaaagagggttggcaagttttccttcctaaaagtggacagaatgaacatttgccaatgtggggggagggtgtacccctggtattgatggagtctcagcaaccaggctcaaaatcgtctccccctataacctatctgtcaagtcctaatgattctaccttcaaaatatctcttccatccacttggtccctcttttctatcctgactgctataggtcagattcttgttaactcttgccttgactacagcaagtagccttttaactgttactgcttctccttcatcacattgcctccttagcaccagttgacaagttctgttctcaaagcactgctcctagcatgccttcgctcccaagacagggtctaaattctttagagggctttcaaggctgcctcatgactttatcccaagtcatctttcctatctcatctggatttgttcttcccccaacaaaagcagcttgcccactgtattagtccattctttttctcctaataaagacatacctgagacttggtgatttataaaggaaagaggtttaatggactcacagttccatgtggctggggaggcctcacaatcgtggcagaaggtgaatgaggagcaaagtcacgtcttacatggtgtcaggcaagagagcttgtgcaggggaactcccatttataaagccatcagatctcatgagacttactcactaccatgagaatatgtgggggaaaccacccccatgattcaattatatccacctggccctacccttgacatgtggggattattacaattcaaggtgagatttgggtggggacacagccaaaccatatcacccacctcacaggacccttcactgcgttggaaccagtctccctcaaatgctatgtccccagtttctccgggctagatttttctctcagatcttcagtttccaagcgtgtagcagctttattaaggaagttattttgatgtctttaatgttacagttcataattacatgtttatctccctcactgtttgggaaccagacacagcattattattttttttctgtaccaccctctcctaacatatgcacagagggcctaccaagccaccttgtacatttgagtaggtactcaataaatatgttttttggtttttctttttagatagagtctcactgtgttgcccctgctgaagtgcggtggcacaatctcgactcattgcaacctctgcctcctggattcaagtgattctcccacctcagcctcccgagtagctgggattatgggcatgcaccaccatgccgggctaatttttgtatttttagtagagacagggtttcaccatgttggccaggctggtcccaaactcctggcctcaagtgatctgcccacctcggcctcccaaaatgttggaattacaagtgtgagccaccacctccggccaataaatatgttttgaattgaattaggaatagcaaaatattatttctatttaagacttcttttcttttctttctttcttttttttttttttttttgagatggaatttccctctgttgcccaggctggaatgcagtggcataatctcggctcactgcaacctccgcctcctgggttcaagcgattctgctacctcagcctcccgaatagctgagactacaggcgtgcgccaccacgcccagctagtttttttgtatttttagtagagacggggtttcaccatgttggccaggctggtcttgaactcctgacctcgtgatccacctgcctcagcctcccaaagtgctgtgatttcaggcgtgagccaccacgcccagcctatttaagactcttttcaaagcttgcttactgattcaacaaagatttattaaaggcctcctgtatgctaagtactgtataggtcctaaggtcatacatatagtaagaatagcttacagagtcaaggtataagttagtaaatcttattcccaatgcatgagaaggaggtcatttaatacctgatgcgttgagatctcacaaatatatctgaaatgagaggtgggcctaaggcagttctttaattcccattaagtaaggtcacccctgccccacccaatgacatatgattatccccaaaatgggtttatgagtatgtaagaaggaaattctatatttgctatttgttaggtttcctatcatcgttcctctcttttctcctttttttcctgagctagggagcaggactttgtgaaaactgtaaaaacctgaaaagacacagggctgctgtcactggtcttttatttcttagtgtgaaggtgggtaaattgagttgcaagagaataaatcacacctcccaccattctttatggatcaggcctcctgcttttagaaacagttctttcccattgttttattaaagcctcacttgtctggaaagaggaagtctgacctttaactttctattcttgtctcatttggagttatttcatgtatccataatatcgacggttgccagaaaactagttctcttgttgcttgatggctggacatctctgtctgtcatggaaacagtactcaagtagccgtcactctttttttctcccaaagtgttatatgggtgcctggtattgcataatgcctgcaccatactttgagtacagagtgaaaataaaagacatttatttctacctgctattttctgctcttccatgtctctcaaacatatttcctaagaagctattgtcatggtcactttgttctttatttcttacagtatcgggatgccctttacaagttcatggtggatactgccgtgcttttaggagctaacagttccagagcagagcatgacatgaagtcagtgctcagattggaaattaagatagctgaggtaagtcttcactgaaaatctctttctttcctttactttcttttcttttcctttactttcttttcctttccttttattaaaggcagtatatcctgaatgaaaatataaattgcaaacaaataatagcgttttgtgtcattgcccattgggcccaaggtagaactaatagcatcccctctaggaagtaacaaggactgtgacagaaaagctcctcattccttccacctccctggtttaagcccattcagtgtccatacgttgctcagctgtggccaaagaatagcagcagagagaccctctgaccgtttttcctggagaaactcatgtttggcttaaatagaagatagatgtttaataaatccttagtaatctggcttgaatggaaggttgcttttaatccagcccatgttttatgctatccccactcagagtcattctggcttaagttctgggctcagggaaatctgtccaccaatactggatataaaagttggtatagaaataggtaggacatgctggtaagcatttttaaacgacctttctggtattactttgtacctgcccctgtttttcattattttcttgccctactttaatgaatatcattgtgtcatatacatgacacagaactacatgtctatgtaaattaccttaacttcttgttggctcattgtagagacaaaaagatgtaaaaacaaacttgtgggcaaaataatgagaactcctaaatggttagctttgtttatggaataacttttttctagaagaaagaaagtgtaaaaatctctctatatgttcctaggccaagagggaataaatgtggtaaaatctgcttctggggaaaccctgtagtgaaaaaaatgatactttttaccaagaaagttttgcgtatgtgttgggaatcttttacaagagaagttggtaaaaatctcgagatgaataagagtccaaatgttgattggttttgtttggcgaggtggtggtggtgtgttgaggtatggagtagggatgaaggataagggtaaggaggaattggtctctctctctttgccgtggtgatgttcgtgtatagctctctccaaactcctacttgcagtgcaaaaagttcattcctgcatgtcacctttgaagactgtgaagactgctgcagatgtttcgaagtccaggactgtgcctctgagccatgtctagagtctgtctgaattctctttccaggcacataggaggcccagggctctcatttggactaaaactctgaaacagcagggaaggccttgccctgagccagggatttggaccaaaaagggaactaaaaacagctgggctgaggcaagactgggaattgtcaaaaggctaaatgaagtgacaaatctattgtgtggaggggagtggctggcagagagctgaaaacagctctgaggccaaagggctccaacttggggctgtgagactccgagggcggaggagggattggtggaagaggagtgtggatatcctctgaggcaatgattcacaccgagccaggaggctgtttgtaagttacatgtggtctctcctgtggagggtgaagaaagggaagctaaggacactgaagcatttagcaaagaggggccagacgtctgccagtcagccctctgtaatttttaccttgaaaaatcactgctagtaatgctcacttccatatcttacactacacatcactaggtacttttaaaattagtgggatacatagtcctatggaaacttctgaagctgggaagacaagacagtccagcccagccaaatacgtccttgtaattacaaccagggaagcatatacttaaccaatccagctagagagatgtgtgcacaaggagaggttttattgatggagtagcccttgtgattggaaccaagtggagtgtaattggaaaggcttgctagatgcagtgagtcttgggcagtcctgagtcatagttcaaaccatggaggtggtgatggtggataggagatgcaagagtcggagagtcatgtgtgcagtgggaaggtggcaagtttaatgcaagggaattagatgatggaaggcccgaaggcaaagtcatgacgtgattgaggggtggatatgtgagctactgctggtcaatggaagtgattaagatgatccttgaggaagataatcattgctgctgttcttaggttaaacatagtggaggctagaagctcagatttggtgttggccaaatggccaagagcatgagtattaggaattgaaagagtatagagccagggctagagagaggcaagttttgaaatgtgtgtccaggcggtgactaaatccatacccccagcaatggggctagggaaatctcaaggccaaagagacaagaggggaaatgagggaatgagctgttgacaaaatgatcacggggaacagtggcatccagatagtcttgtgttcatcagtgaaaatttgcccctagaggtgaagggatggtctgtggttcatgaaatattgaaatcattatctggagaccacaggtgacaatgggatgtttacctcaatgtccaacttaagtttgattgtcaaaattgagccagcaatagattttgcccatccacattatagattgggagggagatttggggtagttctttttgtactggggacaatatttcacacagaggaggatatgaaagtttattttcttaatcctgcctaaagtgatgtctttttttctcttccccgagttggggaccacaccaaagccttgaaaaactttataatactatgcagatgttttggcacatgtaggaagtaatcatacagtaagaaatggttcacttgaaaaaaaataacaaaaatctcttttcaacagataatgattccacatgaaaaccgaaccagcgaggccatgtacaacaaaatgaacatttctgaactgagtgctatgattccccaggttggtgaaaactatccagaaaactttctctcaactcatcattttagaagggattggatttcatctctgtgtaaatttgtgtcttgtaaaacctgctctcagtcttggttatcatcatctttgtcaacaatcacataaaatatcccttgtctgtgtattgggatgccttctgttacagggaacaaaacatctttccaacagtggcttagaaacttaaagcctatattctcacatgacaaaagtctagacataggtaattgttggcattggctcagctgtttaacagtgttgtcaaaggcccaagttctttctatctttccatcctactgtgtttagtgtgttggctttttgacttcatgtttgatgactcatggttccaaggtatccatcacagctccatatatcacatctgctgtcagagcaggaagaaggtgaaagggccagtgatgtgtctaactcttttactaggaaaaacaaacaagcctttccagaacatctccagatgtcttccctttatttcttattgagtaggattgggtcacatggccactcctaaccacaggggaggttgggcaagtgagtaactggttttccgtttcaacagtggacacaggcaaggaagaaaaggttgggaaaagacttttagagtagccaatctaaaaaacaccatatggtgttttaggtaggatagggatgctctgaagaatggaggcatgttactttctgtgtttttatttgtttttttttgagacacagtcttgctgtgtcatccaggctggggtgcagtggtgtgatcttggctcattgcaacctctgcctcccgggttcaagtgattctcctgccttagcctctcgagtagctgggattacaggtgccggccaccacacctagctaatttttgtatttttgatagagatgggattggccaggctggtctcaaactcctgacctcaaatgatccacctgcctcggcctcccaaagtgctgggattacaggtgtgagctaccatgcctggctgcatttactttctgttgctgcttatttcctcttgtgtttttttttttttttttttaaaaactgtgtcacagagacaaattatgtactggggcatctgtttctgtgtgtatgtgagagtgagggagagtacaggacagagaaagggagggagggagagagaaaatgtaccgtatagaggaagaatttagaaggaggaagagaaatgcaggagagaaggagggaagagtatgggaggaagaaagagtatagaatagaggaagagtactggacagggagagagcagaatggggagagaaagacagaggggagagttcaggaaggaggaagagtactggagggggccaagggagtgagggtgcatattactgtgttagtgtgtgtgtgggtgtcgtccagatgtagatggtacagaacacatgctccatttgtgattaagacaataggtcaggccgagcatggtggctcatacctgtaatcccagcacattgggaggccaaggtgggtggatcacttgaagtcaggagttcgagaccagcctggccaacatggtgaaattccacctctactaaaaatacaaaaaaaaaaaaaaaattagccaagtgtggtggcaggtgcctgtaatcccagctactcaggaggctgaggcaggaaaattgcttgaacccaggaggcagaggtaacagtgagccaagatcatgccactgcactccagcctgggtgatagagcgagaatgtctcaaaaaaaaaaaaaaaaaaaaaaaaaaaaaaaagacaataggtctggatggcaatgatcaggagtttattttctagacttgagtagttgcatcttgaattattaggtgtgaaatcaaaagaaatgaatgatgctcaatctactctatctgcctttcttacttgctacctaaccgagattctctcattctgttttgttctctctcccctcagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagtaagaactttcacatgaattttactgtgacttttgtgttttctttaaattataagggcttcccttctcacatcctttgaaaactgtttttaaagaatgttacatcaaaagagtcatagggaaaatcccggtgtcctttgtgatgaactggccaaaagcactgtctggtgtaatttacttgctgcaatgataacaaatgtttttgccctttatttctggtctttctccatgctgttctctttgagatcctaaattgtttatgagcttggggagctagtcatataatgatgttattttctaaaatgtctgtgtgaacatctttttttttccccagttcattctcaatcttttgctgcttttttttttttttcctggttcctttttaaccattaagtcactttctggcaataaactaaagtaactgtattgagaagacacaagaccaccttgagagtggtagaaaaattgcacggataaaacaactttaggaactgccaggtttttcttattttaaagaatgttttagaatttgttgctttgctagtttattgctacaaagaaaaatcttccaatattccaggaaggagaattttacaggttccttaaggcattcagctttgactacagaaaatgaatcacagagcttacaaaatgaatcaacgagtttacaaaacactttactgagttaattgctgggccatgattaaaatcacattttcttatttggactcagacaaggctatgttgccagaagttacgttttttaaaaaaggcacaacagtccttggaagaaaatgtagcatttatcccctacggaaacacttagacacctgagaggagctgctgctctttttaagatactttctgatgataaaagtaatctgtgttcactgaggaaaacatacagaaaaaggagagaagaaacaattaatttacttaaaattctatcatttagagataagccaggattctttgaaaatgttctaaatggaaattgaatctagaggtacgtaattatattgcagggtagagccttgctccatggaccaggaatgtcagcagcatcacctcgggtgcttgttaaaaatgcagattccaaggccctcctccattgagtctgatccagtagagctggaggggaggccaagtaatctttattttaaacaagtacctcagaagaatcttatgattaacttttcttaggggaggggaaggggatcactgtattagaaaatttctttgtaagtacttcctagctctcaaatactataaaatatgacccaaacgattttctactcatatgccattgagttacggagcacattttaaattttggtggtaatttccattgaaaggtggagtttggcctgctttagattcatccttcacctcgtgagtcagtttcttctagtatctgtgttaaaagagtaggtacttctgaacactgattgattttacttccaaaaaagcctaatttacaatcaggggatagattgggatttggtttactgtattagaaaaagcatctctatcgtgatgattttacttggtaattgcaggacctttcataacaatggaaaagagcatgattggagggagattttactctgattcttgtcaaaatgataacttggacaaatataaacgtagagaacaacagtagaaaaaacatagatggaaaagtcaccttagatgttatgtacacatacaacttcatttaaaaataaggacaaaaattggccaggcgcggtggctcacacctgtaatcccagcactttgggaggctgaggtgggcagatcacttgaggccaggagttcaagaccaacctggccaacatggtgaaaccccgtctctacttaaaaaaaatacaaaatttagctgggcgtggtggctggcacctgtaatcccagcgacttgggaagctgaggcaggagaatcgcttgaacccaggaggtggaggttgcagtgagccaaggtcgcaccactgcactccagcctgggtgacatagcgagactctgtcttaaaaaataaataaataaaaataaagccaaatcccaaatctctttcacacagtttatccctcaaccaccagtttataaaaagcaacttgtgttctgcgtattcttgtgagatttcaatacaacgtacacatcatgagaagtctgacagcattttatttgcagactatggtgatgttttttcattgatgatcgtgtttaatcaccactcgtgtagcattacagggctacttgaggaaaagtcttcttgggttcccataattgccatattggtcaggatatgccagttgctataaccagcacctctaaacactcattggctaaattgtaccctctgctcatggaacagtctgaacatgggtgtccctgtaagagagctttcttctaaatagtgacttaggaagccagactcctttcatcttatggctctgccctcccttggatgtttggcatcctctctattcagctggaggatggagaaacagagagggtggaggattgtataggttttggtgggaaggcctagaagtggggtatgtcacttctacccataatccataagccagaactcagtcttgtgactcatctagctgtaggggagactgggaaatatagtttagctatatacccagaaggaaaaggagttggagtttccctagacatgcctttatcaaagagcctatctcattttcttgaaatgaccacttttctctcaatggcaaatacttccctgctccctacctctatgacactgtgagcacctcatggcaggcactcttttttaatttttaatttttgtgggcacaggacatattttgatacaggaatgtaatgcataataatcacatcaaggtaaatggggtatctatcccctcaagcatttgtcctttgtgttacaagcaatccaattatactgttttatttatttaaaaatgtacaattacactatttttgactatagttacctgttgtgctagcaactactaggttttattcattctttctatttttttgtacccattaaccatccctccttccctccttcccctctgctatccttcccaacctccagtaaccacccttctattctctatctctatgaattcaattattttaattgttagctcccacagataagtgagaacatgtgaagtttgtctttctgtgccaggttatttcacttaacattatgatctccagttccactcatgtttctggaaatgacaggatctcattcttttttatggctgaatggtcctccgttgtgtatatgtaccacatttttaaaaatccatttatctgttgatggacacttaggttgcttctggcaggctgtcttgtgattgcttttttaagtgttgtgacctagcacagtgcttctcatgtagtagacactttaaaaattctagaagttaaccagataccccatcaccaccacaaggaggtgacatatgaatggaaccccaaaggataaagaggaattttctaggtagggaagaatagagaaaaggggatggtaagcatcttcagtggtggaaccaatgtgaacttgggtgttgcctgcaaggcagggggctagagagctgagaggccagcttgggctcaggatatgtagaggaaaagcatcagatgaatgttctgaggatccccccacctcctacctttcccttggaggcaccattgaagaaaaagccagccaagccttctcacattgggcatctctgctgtgcctctgtttcgagaatctgcctataaaaatcatatacaggtaatggtgatgttaaccaccactatggttaacatctttgatctttacaacaattctatgcgttgttcccactttacagatgaggaagctgaggttaagtgacttggccaagatcacacctctaagaggaaacagagctgagattctaaatggggtcaccctcatttctatgtcttgtctctttttttccataaatgtcttggtgtgaaaagagatacttttcagatgcttcactgctcattttggagatgctagcgtattgtaccctcagctagttagatattgctagctttggcaattttcctgcaatgttcagcagttcaaagccatcctgtgttggtgtcagctgttcatttcttattttttatttttatttttatttcaataattttgggggaacaggtggtgtttggttgcatggaaaaattctttagtggtgatttctgagattttggtgtacccatcacctgagcagtgtacattgtacccaatatgtagtcttttattgcttaccccctcccactctccccctgagtccccaaagtccattatatcattcttatgcctttgcattctcgtagcttacctcctgcttataagtgagaacatgcgatatatgtttttccattcctgagttacttcacttagaataatcatcttcagctctatccaggctgctgcgaatgccattatttccttcctgtttatggctgagtagtattccatggtgtatatataccacattttctttatccattcgttggttgatgggcatttatgttggttccatatttttgcgattgcaaattgtgctgctgctataaacatgcatgagctagtatcttttttgtataatgacttcttttcctctgggtagatacccagtagtggtattgctggatcaaacggtagttctatttagttctttaaggaatctccatactgttttccatagtggttgtactagtttacattcccaccagcagtgtaaaagtgttcccttttcaccacatccatgccaacatctgttatttttttgatttttgattatggccattctcacaggagtgaggtggtatctcattgtggtttggcacttccctgataattagtgatgttgagcatttttcatatgtttgttggccctttgtatatcttcttttgagaattgtctattcatgtcttttgcccactttttgatgggattgtttgtttttttctttcagctgctcatttctcaattgctgcttctcccttcttatattactcccactgccagtctaggggattaggcctctttctctgactgagtggctgtggggacagtggcactgactctttggtaggtggtgcatggtacagaattagagcaatgagatcctccagtggtggtggtgccaaaccacaccagcccttgcagtccaagggggtaggtggccagggagggacccttggaggaatgagctggaggctgcctgtggggaacaagagctggtgtttgaggtggaaaggggggtggggtaaggaggtagtgatgatccctcatgttatgtgcatctcttcctaactacatgttcggtgatctcatgttgatagtttcaattcaactatgggggattttgacaccatggaaattggcaaatgtaacaaatcatttttctttttcttgacaaggcagttggcaacctttactagcacatcactgggtgaggggcactatagacttctctccctttctgtccccctcaattctcctcctcactcctgactcgaggctgcctcagacacttcccatctacttttatctgaggagtaagagtgggaggaggagaggccaaggaaggttggcatcaggaggagctgacgtgatttcctcttgcaggccagggctggatccatggagatcatctgcgccaggactgttttcttttgttgttgttgttgttttgttttttagcagactggcctagagcaaacccttggagttttgtcaaggaccctgtaagtattcctgtctttagttttattttcatataaagcaagtacaatgtacattaaagtaagatgattcttgttgcatgttcccaaaggatgacctggaaaatgtgctgttatgtggacctctcctgggggccagctcttctgagagtgatctagggtcttgctagccaaagaatggcctacagatgagcagcagagacattactggggagtttgtcagaaatgcagactctcgggctctgccccagacctactgaatcagaggctgaaattgaataagatccccaggggactcatatatacattcaagtttaagaagcactgatgtgggatttaggaagtcctagttgagctgtgtgtgcagaacgatgcggagatggagttttcctagaccagctgttttcaaacctgacacgcctcagaatcccctggagggtttgctaaaatacagtctgctggccccccaccccacagattctgattcagcaggtctggcggtaaggcctaggaattttctaacaagttctcagatgacgctgaagctgctggctcagggacacactttcagaatcactgccttacataagcctctaggcagcctgtaggaagatctctggctttgagaacctttaagaagagcctctgtggctcacttcagatagtatgaccaagacgagcaaatgcaagttctggaatctgaaaacccagatgttagtcctggatttgacacattcttggaagtaccttgacctcttacctttgttttcttcacctgaaaataaggataataataataatcacctcacagcactgttagaaatatcaaagaaggtattttatgatctcttaaatgtgatacaaatgtaagctgccactacaatttgagtatcccttatccaaaatacttgggattggaagtgtttctgattttggatttattcagattttggaatatttgcattataattaccaattgagcatcccaaatctaaaaattaaaagaatcttccaagtcagaggctttaggaaatgatttcatgttgctctctttgtggtgggtgctcttttgagatgctttgcctttctctgtttgatttattgccacttggggaaattaccatatggctgaaaatgtgtttttttgggaaaaaaggatattatgtgttattttcaaggactgttgctgactgtgatttttgctttttgatatatctgagcattaggtgacagtgattcagtcattatggttatatctgttcctggcgtggtaatattagcactccaaaactgtgctccatagcattctgtcagtgtatttataacacactgaagaaactcatcagtgccattgtctcgctgtgtgaacttctcagcattacagcttccagcttgcagaggtctggttgttatgctatcacctttgtaatgccttgtccaggaagtcctcgtaattctttttgtgcccacagatttctgtgaagcatctttgttggagtgttttggggtctctgtgactggccaggaaatcttagctaaattagaggctttggccaggcgtggtggctcacgcctgtaatcccagcaacttgggaggccgagttgggcggattgcttgagtccaggagtttgagaccagcttggcaaaatcatgaaaccctgtctctaccaaaaatacaaaaaaaaatgtgctgagcacagtggcgcatgcctgtagtcccagctacttgggaggctgaggcaggaggttaccttgagcctaggagatcgaggctgtagtgagctgagattgtgccattacactccagcctgggtgacaggagtgagtgaaactctgtctcaaaaaaaaaaaaaaaaaaccaaatagaggctttaattcatcactatctggcatagggaaaagcatgcaggctttagagttagacacacctgggtctggtccggcctccattgcttattacagtggttcttcaacttggcctcacattggacttagctgaggagatttataagcaatatttatgttgggtcccactttagagattgtgacttaattggcctggggtggcctaggcatgtggacttttaacaacttccccaggtgactctactagtttgagactcactgaatatgtgatcgtgagtttacttaatggttctaagcctgaagtctcctcatatgtaaaatgggtataataacatctctcttacagcagcactgtgaggatcataattaatgtgagatgcctaaatgggatgatctcaggggagctggaagggcccctgcttctcaaaccccagtatactttgccatactacatcttccaccaccaccattgggccccctaacaacttccctagttattctggctcatcaccacccctttgagggaatatcttttgaactgatgaaaggacatctgctggctgttgacctccttctcgtctccacctatggatccagcatggttcacatgcctggtaagaggtattttagagacaaagaacataaagtccttgcactaggaccaagatcggcccattaatgtgctagacaccatgacctggtcgctgtctgcatctccccagtgtggctggcctttctgcccacttccttgagtgatgatcctgttcaccatcctctccaacatatcagccgattccaccattatttagcctgtccagagttcacgttcctgtttgcaacaccaaagccttttaacctttcggcatgcttctctcatgaagcctactcttaaccctcagtttgagatgtactatccttacagtgaagtgtctggcacatacttttgggtgctagtgtctaccaaatcattatttatgcacttgcctcatctcccctgctcagctaaaagcttcaggaaatcagggactatccatctccccagcacagagaactgttagtatatatgtgggtgctcaggatgtgttgattgagtgaatgaaagaaagacccttatgtactgacagtgtgtcccttcaattaaacaacccaattacatgaacaagctgaaatctgaagtcctgtgttcccagctggactttgagttctctaactgtaggtgctgggttcttacttctttacgttcctcatggcatctggcacaatacttggccaacaataagtgctcagtgagcacttcttgtcctattaaggagtggagatgtgaatgcaaaagagccaaaggaatgaccccaaaccacttagtggcctcaacagagatgggcaagggctggactttgctgattagtgcagtggtgtcttaggggaatgcgcatatcctaacaagatccattgggtctgagaagaacattttagaacttctatatctttatttaaatttaaaaataattaggctttatacagagtggtataatggactttggagactcagaagcagggagggtaggaaggggatgaggcataaaaaaactatagattggatccagtgtacattacttgggtgatgggtgcactaacatctcagacttcaccactatacaatttatccatataaccaaaaaccatttacatccccaaaagctattgaaataaaaaaactttataaagaaaaataattacactttattgagttctatattgatggctatggacccttcatttgatctgtatggaacatgtgagaggggcactgtcaccctcactggcttgttttcattcaatatattaaaaataatctcagctgatacggtggctcacgcctgtaatcccagcactttgggaggctgaggcgggaggatcacctgaggtcaggagattgagaccagcctgaccaacatggtgaaaccccatcagtactaaaaatatagaaattagccagtcgtggtggcgggcatgtgtaatcccagctacttgggaggctgaggcaggagaattgcttgaacctaggaggcagaggttgcagtgagtggagatcgcgccattgcactccagcttgggcgacagagcaagactccatcttcaaaaaaaaaaaaaaaaatcttgagcggtttacatatagctgtggatttatgaattttattatctagtttatctagtttactacttacaaagtagacaagtggcttaaaaattcttgcaggaaacaggaattgaaatgattattgatgatgtaagcacaagagaacagctagaaattggcagaagtgacccttctcccaggctggtatgccatgttggttagccagatgacaaaagaaatacaatggtggtctaacaagaacaaggacaatggcaatctgacaaagacatgtcatacatttttgaaatagtcaagaagactctaagaaatgtggatttatattcattgtcattgttgtattaaccaaatcctatatggacactgtgtcttgaagaattaacccaatggtgtttgaagaattaatgacttttgaagattttaaatttcattttacctcatcttttgaaatttctgtttttgtatttgttaaaaatattcctaatatattagtctattagtatatctctatagaaattaaacatccatgtattgggtgtgtatgctgaaaaatattttactagtaggagcgcatgtccactgtgtcagaatgtcatacaaatgagagtgtagtttgttcttgatgggcttttagcatcatcatgtcatattgctctcatgtgattggctcaccagaaagccatttcaggaatgtgtgttattagtcaccatggtaatggcacagctgggaggggaatggatcattaaagatccatcatcactattgagttagaaattaactgagatcacacattcttctgaggtcaggtcatcttttgcttatagaaaaaggcaacccttaaaatttaacagatttttaaagatatgtattataggcattacatgagcttatgaggttgttcatacatttggaagtgaaagacaaaaccctagaaattgactatttgtcaagcattttgttatttatttgaaccctgcaacaactctgtaaggtagggatcatcctcattgtatgaaaaataaagataaaatcacagaccttaagtgacttgtcgaaactcacatatttagtaagtatagaatgagggtgcaaaattagatgattggtattagccaatattttgctgttagtttccaaaggcaaagaatacataggcattgtatcaagtcacctaatccagtaagtcctcacttaacatcatcgatagcttcttggaaactgtgactttaagcaaaatgacagataatgaaatcaattttaccataggctaattgatgtaaacaagagttaagttcccatggcatattcctgctcacaaaaacatcaccaaacttctaaataaagaccaaaacacttctaatattgaacattgaatacatgtgagctatgcgtacatttaagaaagacaaataaaagcaagtaagataattttttttgatctttggaacccattcaatgtttttgtagacatattcttttttttatccttgttttcattttttaaattatactttaagttctagggtacatgtgtacaacgtgcaggtttgttacatatgtatacatgtgccatgttggtgtgctgcacccattaactcaactcgtcatttacattaggtatatctcctaatgctatccctcccccctccctctatgcagccataaaaaatgatgagttcatgtcctttgtagggacatggatgaagctggaaaccatcattctcagcaaactatcacaaggacaaaaaaccaaacaccgcatgttctcactcgtaggtgggaattgaacaatgagaacacttggacacaggaaggggaaagtaagataattattaacccagttattctagttcagggttgcaggtgctggagcctatctaggcagctcagggcaccaggcaggatccagccctggctaggatgccatcctgtcacagggtgcagtagctcaccatgctcactcacactgggaatgtgtagacacgccgattaacctagcaggcacatctttgggatgtgggaggaaaccacagcacccagagaaaacctgtgcagacttgaggagaatgtgcaaactctacacagacagtgaccctggcccagaattggttttttccttatcaactgtataacaaaaggatgttgaatgaaatgatgttattcgaggatctgctgtaatttgaaggtactcacaatttccagacacgaaaggctgtgtaacagtggactttataccctgagagtgaaagtaaaatgttcactctgagggctggagctggaatctttccttcatctatctctgttaggtggtgaaaagcaagccaattttggttgtgcttattgacattgtatcatcttatgtcatttctcaagtgaaagttctgcatttttgtatgagtaagaggtccctcgatggagctttgccaactgtttctctcaagatgttctgcagagcatcagatattgacctaaaatacaataaatgggcatctctctctgttaacaggaccattgccaactatttggtgtggagaatggtttattccagaattccaaaccttagcaggcgctttcagtatagatggctggaattctcaagggtaagtttaagaagattgcagtgttacatcgctggataactttacatgctggaatagtccatatattaactgatccagtaaaaatcatctttagggattagacagggggagtttgtagcccaagctctattgtttttgtgtgtgtgtgtgtgccttatttatttttatttaggtataaattacatatggtaaggtacactcaagttttactttgatgggttatataaagatatttagagaaatacttgaggccacacattgttttcaaacttccccgtcttattagtgtattcccattttcccccagagtttttaactgggtcactgtaattatagttttaacatttctttgtgatatatttgtaactatcttttattctcagtattctgaatatttaaaatgtgcatgatagagatattggatggtagaacttcattttcaatttggaaatggaattttgtcttaaactttgcctataccttccatctttgaatctatcctctgctaggtccaagaggctccaatttagttttcttgctcaactgtctgagatggttttcctccacctgctcacctggctctttatttatttatttttattagagatggggtcttgccatgttgcccaggcttgtcttgaactccagagctcaagtgatcctctcacctcagcttcccaaagtgctgggattaaaggcacgagccactgtgccgggcctcacctggctctttaacctttgcttctctcccacccttgctcgtctcccagtttgtacccatgttactctcacctttgtttttgaggcttatgtctgactaattctcctaccactagaggccgtaaggattttgtatctttgaaacagtttttatttttctatcaatttaaagttaagtgaatggtgaatcttataagctatgatttcattcaagaggcattttagttattagaggaactaataagtatagaaattcttagtgggccattactctggaagagtagtgcaattattttggatatgctttgaccctataaagtcactagcatataaagttactttagggctgggtgcagtggctcacacctgtaatcccagcactttgggaggccaaggcaggcaaattgaggtcaggagtttgagaccagcctggccaacgtggtgaaacctcgtctctacaaaaaatacaaaaattagccgggcatggtgtcacgcacctgtggtcccagctactcggggggctgaggcaggagaattgcttgaatccgggaggcggaggctacagtgaactgagatgatggcaccaatgcactccagcctgggcaacagagcaagactccgtctcaaaaaaaagaaaaaaagtcttttttacagagaacagcataaaacaactatatatatatttaggtcatattgatgggttaagatacaaaacaagtaggttttgtgtgtgtgtgtgtgtgtgtgtgtgtgtgtgtgtgtgtgtgtgtgtgtttgtgtgtatttttaactgctacgaatcacataaaagatgatgcccagctgctttccacccctactgtgaagagaatgagagaggtgtaagaagcactgtgtgaacatttaaggttaggtatgaggggatgtttcttgagcacgaagtgctaaatataatattgaattgccgaagaaggttgtaggatctctttctctagaggttttaaaaatagattcatcgcttacctctgagagaggttaccagaaatcagaggaagaatagatgaaattaagccttaatcccattcctcaaaacaacctgggtctaacattgtgcaaaggacacttctgaccaccattctcagggcctcccttcctccctgcctgcacccccagcttccaagggcaacttacactatatttatttctctgcttttattcccaagagtaaacctctgacccaggtcctgcttgggaaacttcttacttgtttgtaaatgttttcttgcaatggtataattgggacagatgggcaaagcatttacatctgtattttgcttgtttatcagtgtgttttttgctgtgacacaatgtaaatatgctccctgtgttgttcatggtgggccatgttcttctggtctgccttgttgagtgtgctactcggagcaaggaaaccctcactgggcaggaactttgatcacccactgattctagaccttcttagtggaactttagttctcaggagatattaaatattatctagacacttggatagcatcctctcatgtccctgctaactgcagaaaagtgataccattgtccagattctttgtttaatggggaaaattgggaagaaaggatacatatattattttaactgttaaatcactttcttttcttcttcttctttttttttttttttttttttttccagacagagtctcactctattgcccaggctggagtgcagtggcccaatctcagctcactgcaaccaccgcttcctgggttcacacaattctcccacctcagcctcccaagtagctgggattacaggcatgcaccaccgtgcccggctaatttttgtgtttttagtaagcacggggtttcaccatgttggccaggctggtctcgagctcctgacctcaggtgatctgctcacctgggcttcttaaagtgctgggattacagatgtgagccactttgaccggcctaaaacattttcatttagtttgaaatataatggggacaagcagaatttttttcttcaactattttacctttgcctctactatctgatgcatatatatgggttagggtgtgcagtgttttgtagactgttttcttcaggttgtttgaattgttttcagccatgggttttatccaaatgaagtttaatctggatcaattatctcccacaggtaatccaggggaccacaactttgctgcctcaatgggacaaatgtgtaaactttattgaaagtgccctcccttatgttgttggaaagatgtttgtagatgtgtacttccaggaagataagaaggaaatggtaagtggtactccccagctagcaaaaaataatggcaatttagccagatctgacaagggtatattcaacaggctaatgtcagccttccaggtggtagtggcctgtgggtattgtcttcagattctttcaacttctaagtgaaataggaagaaaggtcatcaaacgagagtgaggatgagttagcaggtattgaaggttagaggagagagaaggtgtgtagttttccaggggagtgggagagtgaataaactgagggaatgtagtatagctgcttgagggcaggcatgtccagatgtaggtgaggtttgaggtattgaatttaaagagggactcatcactgtggcaacgtgttcttctccatctgtttcaactgcattggagaaaagggtgtatttttttttctttcagctttattgagatgcatttgactaataacaattgtatatattcgaagtatacggccgggcgcagtggctcacacctgtaatcctagtactttgagaggctaagccgggcagatcacttgaggtcaggagtttgaggccagcctggccaacatggtaaaaccccatctctactaaaaaaaatacaaaatttatctgggcgtggtggcaggcacctgtaatcccagctatttgggaggctgaggcaggagaattgcttgaaccccggaggcggaggttgcagtgagccgagatcgcgccactgcccttcagccaaggcgacagagcgagactctgtctcaaaacaaacacaaagtatacaagatgatgatttgacatacattgtgaaatggttgccacaatcaaatgaacacatctgttgtcacacttatttaccattgtgtgtgtggtggtgggggatgaggacacttaagatttactgtcttagcaaattcaagtatacaatacattattagtaactatagtcaccatgccatattttagatccccataacttattcatcttagaactagaagtttgtaccctttgatcaatatctccccatttccctgcccccagcccctggcaactactgttctactctctgcttctatattttaacttttataaagattctacatataagtgagatcatataatatttgtctttctgtgcctggcttatttcacttagcataatgtcctctggctttatctatgctgttgcaaaaggcaggattttcttcatttcttcatttttatggccaaatattccattgtgtggtacacacatgcacacatcgcagtttccttatgtatttatccattgaagggtatttaggtttattccatatcttggctattatgaataatgctgcaatgaacatgaaggtgcagatctttcttccatatactgattttacttactttggatatatacccagtagtgggatggctggattgaatggtagtcctatttttatttttttgaagattttccatgctattttccataatggctgtaccagtttacattcttaccaacagtatatgagcgtttcctttttttccaggaatattttgccaacacttacctcttaaatttttgatcatagccatcctaacaggtagtgaagtgctatttcattatggtttgatttgcatttccctgatgattagtgatgaaaaccttttcataaacctcctgtttatgtgtcgtctttggaaaaatgtctattcagatcttttgcctattttttaatcagattattcgttttttcactattgagagggtgtattttgaattagaaacatggatttggccaagttttttgtctgcattttatttttgatgaattatattttacaaatgtcatgaagtaaaagatccaggcatgattaataataatccgtgtagtcaataagatacaaatatatgagcagcttggatgcaggtggtcaataaacactgaattaaagggcaaagacattgtaatgtcatgattgttcaaatgattggtatcacgtagtgatacataataataccaaatggttggtattatgtatcagtacatagtcattattgatacataatacatgattatgtattatgcactgaagtttgctttgcaataccatatctaagtacatttgtggcaggccaggtctcactaacacaggcctccatcacaactgtcccagcacgtactgagtagctaggttaaacattaaaagctgattgaaccactgcccatatacaaagcctggaatgtaacaaagagcccaccaagagttttgcctaggcttttcctggatcttgaagcatgacaagataatgaatgaattcttaacaggacccttttaggattaaacaagttttattgggggtctgaagaaactccacaggcctccacaaacaagtttactggggtctaaaggaactccccaaacctttatgatttagcaggagacaagataagggtaattacctcagtacctagacccatttagattaagtaaacttactgaggctccagaagaaggtcttcaagactcacacctagttatagattaaaagaagttaatcatttatgtctttcgacgattgcacactttcacgtagacatatagcttagaaggtatatgagctctagaaaactttgtaactttgagttggtctggtgataatttccaggctttctccctgtaaccagtggcagaaaataaaactctgttcttccccagttcatttgcatctcgttattgggccgtgagaaatagcagcctgaccctcagtttggtctgggaacaaattgacctatgttaacttgtttttactgtctaactatgagactttatgtttgaacctgaaagttcccttgcaaataattccactgaggaattaatggcttatttcaaaatactcagtattctcattgcgtgttttcttttgctctttggtcagagtaaatagattgagatcttatcagataatcacagtagtaatattataatctctgggaaggctataaaaacaattaaaggataatgaaagatttaaaaaaattatagcaggttttttggcagtagaagaattttaactaatatgaaaagtatgtggattaaacttgtttttctcagttttggtgtgaaagtcccttttccttgtgtcagggtatgacattctaaaataaagttaattttggcatcttcccccttattttgatgtacgtgggggtagtttggtagttaggcagatactcatctctttaacgtaaaattgtttgcctcccttgtgctgaagctgtttgcctcagggaatacttaggttggaaacttataagagaaatatctggccttttatagcctttttttttacagggctcccatccaagaaccacctggaaccactgatttacttgaaaaacattcagtattattagctacagtctaaagaaaaagaaaaacagaaagatccccaaaggggcaaattccagagaccctaactcagatggaaggctgccattgtttatttaccaaaaaagtttgttaagcaaatgaatacagtcagaagcttaaacttcaggtatgtctcaaatttacatgtgtacataaatcacgtgagcatctgcttgttaaaaatgcagattctcattgcattttaacaaggttttttttttttaagttgtgtttggggtaggacccaagaatttgcctaacaaggttccaggtgcgactgctgctgctggtcgtggaccacactttgcgcagcaaggtcttctcatgattcatttgtttgtaaacagcaccaaaaaaaaaaaaaaaaaaaaaaaaaagcctcggtgactcacaagagcaggccaggccagttgacatgaatagcagtactttatttaccaaaaccggttacattagtgcaagtaactgctttaattttcagatcattgaaaatttctgtgattcagattggtttaaatggactgtgaaaaaccctgcgttaggacctccaggctttatcttttgaaaactgatacctaggttttactaagagactcccgccccacttctcctccgtgtctgttttgagaacctcttgatgacagagttggcccaactgcctgtggttggtaccctctcttctaaagagtgagtgggagagagcagttcacattgaggtttcctacctatcagtgttctcctccttttcactggggaaaacacataattctatattactgtttcactaagacttcctacatccaactgtgcatttggacacaccgatacaccaacgttctcatactcattcacacacacaaccatgggaatttagcaaattgaattagaaatgagaagaatagcatgtagaaaaggagagtccttcaacagaaagccaccaaaagaggtcatatagtacaatcccttgcctcccagttagcaggacagagccttaactcgtgagattggctgcaagtgttgctttgtctttgcagtccaaagtagcactacccaattgaactggaatatgagccacatattttttttgagacagggtctcactctgttgcccaggctggagtgcagtggcgtgatctcggctcactgccacctccgcctccctgtgttgggattacaggcatgagccactacccctggcctccattgacttttatattaacattttctccctccttacctccctttcttcccccattccccagaactaaaaatcataactttgtctatcagaggacttctttaattttttatcttatttagatgaagattatttataattttaaaacattccattagctaagcatttaatattacttttgtggaaagttacatgaaagtgggactcccctagagaattgatgatatatcatcactgtaaatagagatgatgctctcgttccactgtgccaagccctgatccatatgctcatgacctaaatggcaggagagaggattagttgtgttcaggaaggatgtctagagttatcacttgctaattttcccctttatttatttttattttttaatactcttgtctttttctttttcttttttttttttttgagacagagtcttgctccatcacccaggctgaagtgcactggcatgatcttggctcattgcaacctctgcctcctgggttcaagccattcttgtgcctcagcctcatgagtagctgggattacaggtgtgcaccaccaggcccagctaatttttgtattttttttgggtagagatgtggtttcctcatgttggccaagctggtcttgaactcctgactttaagtgatctccctgcctcagcctcccaaggtgctgggattatagacgtgagccaccacgcctggccttgtttgattattattattattgcttatatctgtaatgtataagtaagtgccccaggtagatactcatgtccatggagggcaggtgaaggttccaacgaaggccagggaatgaagggattgtcaccatgggcctagttgtgactgtgatggtcaggacatattggttttaaaatgtggtgatgataataacagtagcagttagctttcactgaggtttaactagctgtctggtattcttttaagtgctttcagtgtgtgaactcacttatcctcacaatgaccctgttactgctgttagtgccctcattttccagatgaggaaacaggctcagagagttgaagtaaattctctggagtcatatagcttgaaaatggcttaggtagggttcaagcccagacaatctacatggaaaccagtgttccattcccttgcttatctctgaaggcacttgaatctttgccagttttacgaatatgaggagaccagaaccttcttagtggcttatcttataattacccttgttagcaaattattctaatattaagatcctaaaagggcatacatttcatattttttaacatttcagaggtaggaaacagttggaataggtttggcttccagtatttcaaaattttaaatataaatatagtggaaacctaattcatatccaaccagttgacatcacatttttgtattcatataattctcaggagaaagacggaaatgataagaagcaagctactattgatttaatctaagaataaccttgcaggtatatctttggctcagtctacacactgagctcaatttctcgtattttgtacatacgtcattctaaggagtgatccctgatgtttgcagtggtaacccaaaggctctgtaagatttattatcaaagtttaaaaaaaaatgtttaccattctctactaaggcggaaatgtgaatatatacatcaaagaaattttttttctattgtgttgatgggaaaaaaggccttgttgctgtaactctagtttctagaaaattcagtaaagctgaagttcccatgtgaacattttggctgggctaagttcttctgtataaaccatgtcttggtttgtttcattgtagacactatgtccccaaactgcttatctttattcatatatctcatctctgccagtaggtattttttgctgctccctcaaattttctgcatttttcttatagagtaaaccctgctaaagcaaataattattttgacacttgttaaaatagtaatgaagactattcaggactattgcaagaggtgtcaagtctattgcaacaggggagaaagattaggcccaactctaaatacagcaaagatagctggagatttatagccagtgaggagaatgagggggtcagtggatggaaaattatgaagaggagacatcacgagcagggaaattcttgttaaaccaacttgacaggattcttgtggaaggcaggccaaggtgatcaggatggggattctttctaaagtgacttagcaggattcttgctacaactggactagacaggcttgtcgaggacaggatgggggtgggaggctgggaggagggtaagggcaagacgtacttgagaagagggctcagaggagcctgactaaactttggtcaaggagagagtctttgtcagctctcagatcaaagctaaagtcactgatctcctgtcatatattaaaacattctatatgcagaaggttaatctagttaaagcagagcaaatctattacacttcagattcagattttattaagtgaagaactaaaacttgactccctatgtagaacaattcactaatttctcctgcactctagcagctattctatttctctttaaagacattgttcatgtccccaagtaatgccatggatgccctaaaatatcttccattttttctgagctgctctctgcctgagcaattccagtagtaattcttatcctaagaaaagaattctcctcccaccccatactgctacatctggtgttgaagacttaaatacccacgtgggtccaattgcagtggcggagtttgaacttgcaacctcaatacactagaagttcacctcattagtgagctaagataattgaattgatgtactgccattaatattctttaagttctccaattccctcgctcactgtttctctcagtggttgagtaaatgagatgtaactataacgttgatggcagaagtcacatgaaactcagtgtcatgcattatagcattgcccttatactgaggagtttttcgttccttgcaaattcagctgctcacaaaggttgttctcagtaaagccactgtacagataaagacaatggtcccttcatcacaaattgtgaaagaaaggatattctctttggctactaaatgcccgtttctgtttgtctagtaagtggtgttggttattattatcaagatcactttccagagaaactttgctgaagacctgtccaaattaaggcaaaccatgatgatttggttttttaagggctttttaatatatttataaaatattgacctaatatagaaattacatctgattttctgcaaagttgcattgatagctcatagcccagctctgctcttaccaacatgggcaaatcagttaacttctttgagcttgttttcctgttataaatgatgcaagagtttctgttgctttggtaatgctgtgtaacaatcaatcacaaagcctcactggcatttgacaataagcagttactgctgatgcatctggagtcagtggtgggcccccatgcagctctgttgattttggccaggctggcttgaatttctgggggttggctgatcaaggttggctttggcagaggtgattggaatgactcggctctgcttcatgtgtcctgcttccttcagccggctagcctgtgcatgttctcatggtgatggcagaagttcaagcaagcaagtagaaacatgtgaggtctcctgagacctaggctcaggacaggcataatgtaatatctgcattttgttggccaaagcaagtcacaaggccggtccagatttacagactagggagatagggtctgcatttttttttttttttttttttttgagacaaggtctggctctgtcccccaggctggagtgcagtggtgcgatctcggctcactgcagcctctgcctcccaggctcaagccatcttcccactttagcctgcgagtagctgggactacaggtgtgcgccatgatgcccggctaatttttgtattttttgtagagatggggctttggcgtgttgtccaggctggtcttggactcgtgagcttaagcgatctgcccgccttggcttcccaaagtgttaggattacaggtgtgagccacctgtaactctgcatttttaatgagaggatctgcaaagtcacacagtaaggggtgtggataaatgaaggagtatggcattaaagctgtcagtgctgtgtatcacaaatagggataaaagtatacctccttctttcatttgaggtgagagttaaatgatataatctatgtagaaggcctagcataatacctggtacacaaaaagtgctcagtgaatgtcatctactcttattgctaatattgccatgcctaatgttaataattaagatagaatttataatatcaacttcctggcacagctgtggcaacttctgcatttagattgcctctttttaatttatcatagagtgagggaggtgcctggggggttttgctgtcgctactcctccatacatgcctagtatagtagctttcattggaataaagatccttttcatgttagtgccctggccacattccagaacccaccctatcatttaacgccaagtctggctcatacaagagtctcatgaaattactcatgaaattactcgaggagccaaatataatttctttttcttttttttttttttttgagaccaagtctcgccctgttgcccaggctggagtgcagtggtgcgatcttggctcactgcaagctctgcctcccgggttcacgccattttcccgcctcagcctcccaagtagctgggaccacaggtgcatgccacctcgcctggctaattttttgtatttttagtagagatggggtttcactgtgttagccaggatggtctcgatctcctgacctcgtgatctgccctcctcagcgtcccaaagtgctgggattacaggcatgagccaccatgcccggccatgtaatttctagaataggtccagatttcataaccctctgcaggctaaatcttgttacaacaaatatcatccggtcccaatcgtgacagctcatttatgcaatcttcggtcaagtaacatccagcaaaacaagtaatttagatagctcattgggaattcttttgaaataagtatgaacacttactcttgtccttgtctttgagtgtgctgccacgacgatgacacattggctcacctttcttgtttgttttctccatttctggctagcattgggcagtgttgcctttgccacatattatcagccacagtcttgtcaagcagatctggtcagacctatggaatgtgaagaccctttattagaaattcatttacctaaagaaaacatttatgccttccaacagatctgaatgttggaagtgaccagacatagttacttgctggggagaatttacccacagccaaaggctagactatttgagactgattgacttgtaaatattattctggtttctgatccatcctctcttaaagttggaaagtggaaaacaggaaaagatgagttataaaattagaacacagcctatatgttcatatccagcaaatagaaatataaatatctacctgagtcttatgaatatatacctttagataaaaggacatgagaaactcctcctgtaccaccagaataacccactttatagcaccaaataatttgattttttcttcttttgccaaaatgtttaatagctatgtaacactgctaatcctgacaaactgatatgatttattcactcacttggctgccagaaacctcagcattttctaactatccttagttcttctggtttaaccacatgtcccacttcaatataggtcactttttacttattttgttgccattattttttatcaggagccaatccaagggcatttttataaatagttatagtataagtaattaattaatgaatatttcatatttattggtgcattcatttatttaatgtctgtgtttctagtaaagtgacaattgccagaaagaaaattttaagagtccccctgagattaaagcctatttcttcagggttatccacataaattattaacaacgatttccatttttcacattccaccaatcagtggttacaactcaagaaaacttgccctgttctagagcaatgagaagactggaaacattttaatctcatggtttttttccagatattataacttctaagtatgttaaagaggaaagcctactcaacattatgccttttcgttaagaattttattaacattaaattagtttaaggttaatgcccataatcaaccttactgattttttttctttttcctttcttttctttttcagaactcctagcctataattattcctactagatatgtactatatttttaaaccattccaagctgtttgtcatgtaccatgttgacatcacctatcttagaatggactaggctaacttacagagtcacttgatttccactaaagtttgtgtttggtagtaggctacagtcattctggagacatttgctgtgaaccttgtcccctaatataacgatggattttctattcactgataagttctactcatggattcaggctttgaattactaaatcagagtaggtctctcttttcaaaaatgacttcacctaaaaagggtaccatgcattttttttttccctttttcagctttcatgttgttaaatctcatgatcatatctgcacagcaccatattttctatgagtgagtttgttaatattttctctttatactattggaataactgttatctgttagcatatatgaaagatatttgattcaatttcaactctgctaggtgccaattgaaggtttcaaaaagcataaattgatcagcttgtatttactgagcatctgctatattttagtattaggtatgaatgtgagatatggactcgtgaaaaatcatatcacatgagatatgaaatcataaaactaacaaaattttaaattagcagaatacttttttgtttgcttacatattcatgatctcatttgatctaaatcatggttcctgttctcaaagcttatgggtcttgttagggagaccaaataaatataaatgaaaagacaacaattaaacacacacctatgtattattctgattttaagcctcacaggaactcagagagggaattgaaagtgtgggtttaagtgtttgggattcatgggtatgagataggatttgagttgccttgtgggatttctttattatcagggacaaagctttgaagaaaactacaaccgatcatggggcaaactaatccctccttaaagcaatgttggcatatgtcccttcaaatgtattaatagaaccatcatgactcatttatgcaaagtacagaattcttatgtctatgtgatgggaggaagggtaaggagagggcaagaggagcaggagagataatttataatttgctaagataggagcatctcattaaagtaaagccctggattgaagggtaacaagtgcctatgcatatgtgactcaccaatgtctggtgtctgatgtagaactctatgggcaaaatcctggggtgcaaagaatgaaaaaggaagaacctatttttagataacactggttgaggaagagaactaagaactgcccatagatcaaccaaatgaactgtatttttatagtgtggatccataaaatctgaaatagttgtttttttttttttttttttttttttgagacagagtcttgctctgtcacccaggctcgagtgcagtggggtgatctcagctcactgcaccctccacctcccgggttcaagcgattcttgtgcctcagcctctcgagtagctgagattacagttgcccgccaccatgcctggctaatttttgtatttttagtagagacagggtttcaccatgttggccaggctggtcttgagctcctgacctcaggtgattcgcccacctcggcctcccaaagtgctgggattacaggtgggagccattgcgccctgcccctgaaataaatagatatttaacaaaacgttgctttgcctagagggctcttaccctgaatatggcagattttaccaaaataacacttgagttaatttttatatgttatattttgacctttgactggctctaaataaatatttcctatggataacttcaccttaagacttccactttaagggatttctattaatgttatatgctgcctggttgaggtgtgaggtccaagtttggtgaagaaatactatttctctatttttttcttattttaaaattacagcaggtttttgacttgactgaaggcaatgttattatgtgatgctgtagagtagtctaaagataaaaatcagaagtgttcagtgatttatcttcctagttccagcatgctaaaataattatttctcttatttgcattgacatgtcaaccaatgaaattaatcaccttcaaagattttccttgttcttgaagtctgctggggtagttcaacaccatttcacagaaaatgttatacaataaatctgtaaagtctgccaaaaaaaaaaaaattgagaacctgaggtgggggatggtgtggggagtggaggtgccagagaagacaagggcaaagagcagctgaggctcatgggaaaaaaaaagtgatttacccgcgttttgacaaatgtgagagggccacaaagagtgagttaccgaagtgtggattcagggaagacagaggtggtgggggcaggggaggaggtggaagaaaaggcagaggagggaggaactggcatgtgaataaactatttgtcatttttcactctggcagtgggctgaaatgtttttgcctctttttattttcatttagaatgccaatcaatgggttacagacaaagagctttgaaaaccttttcttatttatttatttagagacggaatcttgctctgtcgcccaggctggagtgctgtggcgcgatcttggctcactgcaacctccgcctcgcgggttcaagcaattatcctgtctcagcctcccaagttgctgaggttacaggcatgtgccaccacacctggctaatttctttttttgtatctagtagagacggggtttcaccatgttggtcaggctggtcttgaactccagacctcaggtgatccaaccgcctcagcctcccaaagtgctgggattacaggcgtgagccactgcacccgccctgaaaaccttttcaaaatgcattaaattttaatgaatttgatagccattttaatgcctgggagatgctggacagggagggtcctatgaaaccaagctgcttagagagaagtatctggaaacactcagccccattttaataatagccacatactccataaaaatacctcaaagagaacaggagcaaaatgaccttaagattcatcataggaatccaaaaattccaaaatttgctgaagatctttttagcttggagagtgcttatttttttgataatttattttaaaacctaataaaatgttttgcttttgtacaccttgtcccaaataaatattttctttggacatattcaactttttattatttattgggtgctttctattattgctacatcctggccagggtattgagagggaaccttttattgtcctctttgtccctatctgtaaatatagtaatccccccttatctgagacagatactttccaagaccccccccaacccccgcccagtggatgagactggggatagtactaaactctatatatactatgtttttcctatgcatatataactatcataaggtttattttataaagtaggcacagtaagagattaacaccaataactaataataaaatagaacagttataatgatatactgtaataaaagttatgtgaatgtggtctctctttctctcaaagtatcttatggtattgaactcatgcatgtacttcctatgatctgtctgataaccaagatagctagcaagtgactattgggtgcgtatatacagggtggagatgctggacaaacgaagggtgattcacatcccgggccagacaggctgggatggcatgaaacttcatcacactaatcagaatggtgtgcaatttaaaatttgtgaattgtttatttctggaattttccatttaatattttcagaacacagttgcccataggtaactgaaactatggaaagcaaaatcgtgaataagggggtactactgtacttctcttcctagtaatatgttcatgctgccaggatgcacatagccatgtgcgaagaaatataattttttagataaacctccctttaagcagaaggtctcaatcctatttcatggagaaaagacccacgtttatactaggactctctcaaccttctacatctaatctttagattcttctgcatgcctgcctatcattttaatcttctctcctctcataagtctgtctcatatctaaggtgaatccttccatatagtctctggatcccatcacctcctttgccctctgagacaccactcatggcttgctttgtcccatattttcagtctcttccttttcgctggatcctttctattggtatttaaacatagtcaaatctctcagcttttcaacaacaacaaaaacagtaggaacagcattagcaagcatatgcatgaaacccaaactccaaaccctcagacccttcccttaaccctacctctacttctctcctatctttgctttttctccttcatagacaaactcaattaatttgtccagacttgctgtcttcgcttcccacacactcttcatcccactagtttggcttctgtccccatccctctttttcttccaattttctcagtcttattgaatgacggtgtttgccaatatctttctgaagcctaggaatgaatctgactctctctacgttcctcactttcccacataaaatgagtcacctgtttccattggtttggtctctaaatctctcctttgagtccacccacttctttccctccccattgcccctccctaatttgggaagatataatttctttttctctgtgaacgtgatgggccagccaatgcatgttgctacatgatgagtccctaaagacttagggccaggtgtggtggctcacgcctgtaatcccagcactttgggagactgaggcgggtggatcacctgagctcggaggttcgagactagcctgggcaatatggtgaaagcccgtctctactaaaaatacacaaaaattagctgggcatggtggtgcatgtctgtgatcccagctacttaggaggctgaggcagaagaatcgcttgaacctgggaggtggaggttacagtgagcagtgagccaagatcatgccactgcactccagcctgggcgacacagtcagactcattctcaaaaaaaaaaaaaaaaaaaaaaaacttaggcatgctgataggcaaaagatctagtccccggagatttccttgtcattttaacatcctcctgatgtgggttttctgtttgaaattgtgacttatgcatctctcagttgattccctttcactccctggcatttctctctgattttgggagggatcctctgttgttactagaggctctgagctctccactgttattttagctctttggtcaggtcctggctctggtcctcattagctgtgtcagcttgagcagatcatagactccttgacccttaatttccttatctgtcaaataaatggtttcccctggtctagtgggtctcagccctgactgcacattagaattacctggggaactttttaaaccctcccaatgcccaggctggacctcagaacaatgatactagcatcccgatgcccacgacgcaggattttttattttatttagaaattttttgtcagtattattttttttttcttttgagactgagtctcgctctgtcacccagactggagtgcagtggtgtaatctcagctcactgtgacctctgcctcccgagttccagtgattctcctgcctcagcctcctgagtagctgggattacaggcgcctgctactacacccagctaattttttgtatttttagtagagacggggtttcaccatgttggccaggctggtctcgaactcctgacctcaagtaatctgcccgcctcagcctcccaaagtgctgggattacaggtatgagcccctgcggccagctctcagtattttttaaagttcctccaaagattctaatgggcagacaaagttaagaaccaccgacttaatgatttttaaaggaccttttgctctttgctcttctagcagtttgtgttttatcccaagttgaagtttctcttcttttaatgtttttaccaagttgggaagaaatagctgtgaagctcccccgacccccttccatctgctgtttgttcttatttacatatgatggaacccagcccactgatttatagctctggttccctcacaactgttattgaactgaaaacatagctgaaaacttattaaacagaaaaaacttattttgagcttcatgctgacaatttattatagaaccaaggaaacatttcaacgtctttccttctagagttaatgttaacaattgatttacaaccccatgctctcaaatgaaaaagttcattctggggccaaacccagtgttttttttttcttgggtgtcccattgagaaagccaaagcatctctgcaggagaactggatttcgaggggtttgtatccatgaacaggcagggcctcctcacattgctgccggtggcctctaatgtgacgtgtcagtagcccctttcctccagtcctctcttctggtccacagacaccggcagcaaagccaggcacgtacatcctcactatgggtgtggcctcactgttcaaatgctttgcgataggtctttcagaagtccacctttcggtagcagccccctttagacctaccattttattttattattatttttttagagacaaggtctcactctgtcacccaggctgaagtatagtggtacagtcatagcttactgcagcctcaaactcctgagctcaagtgatcttcctgcctcagcctcctgagtacctaggactacaggtgcaggcgccaccatgcctggcctttaaaaaataattttgtttttatagagatgaggtcctcttgtgttgcccaggctggtctcgaactcctggcctcaagcaatcctcctgcttcggccttccaaagtcctgagattataggggtgagccactgcccctggcctatacctacccttttaaattggaaataacaagacttttctgagctgccaaggagtagagaggagagtaggaagatgatatagaagagccgaacatttagtttaacccacggaactaaatctggaaagaactggggtcctgacataagtgtgattcatattggtgaagtgtcctttggggtgctaagtctccctgcccgtttctctgtgttaacagttatctctttcaactgttcactttcttctgcaatacctatctgaaatgcacagcccatgcctttcctgtctctctcagtcctttattaaatgattaaaattagttggcaccttgataaggatgaactagtttagtagctacagacaggtaagttattggtttgtcataatctatggtgaattcctatccctgtatacccgtataattcattttatagctgggccaccacattattctcatggaaagaaatggttttttttttttaatgttttttattttttggagacagggtcttgctttgttgcccaggctggagtacagtggtgcagtcatggctcactgcaacctccacctcttgggctcaagcaatcctctcacttcagcctcctgagtagctgggactaaggcatttgcctctacaccaagctaatttttatattttttgtagagatggggttttgccatgttgcccatgttggtcttgaactcctgggctcaagggatctgctcatctcagcctcccaaagtcctgggattacaggcatgagccaccatgcccagctaatttttatatttttggtagagatggggtttcaccatgttgtccgcgctggtctcaaactcctgggctcaagtgatccacctgccttggcctcccaaattgttgggattacaggcatgagccaccatgctgggcctggttagttatcttttagtggtggaaaaaagggaattttcctggaaaaagaagtgttgccagagcatggagtcaagctgaaagaaccccttacttaccatgttgagtaaagagtcatttctcatgcaagccaattttgttccagaaaacctcgactgaagcttcttggctttgacgttccctctttgggtattttcttgtagatggaggaattggttgagggcgttcgctgggcctttattgacatgctagagaaagaaaatgagtggatggatgcaggaacgaaaaggaaagccaaagaaaaggtaaggattccttttgatgaaaaaaaaataagacttctggtttaatggatgttcatgcttgacattgactgtgtagttggtttttatattgactgaactgttgactctgaatgaccccagagttagctgtctgcttttggatgaatacatagatttttgtttcaccaggaggtaagagaaaataatacctgaatttttcgaactgcattttcaaataccttgtaattcggcctttcctttctcctaattgctgtctgtaagaggcacatggcttgctgcctggtgaattgtgtcataaaccatcactggatatggcagaatgcagagcagtggggagtcacagggagcagctggaacaagagcccctaagacaccaaaacgaagaaaacccatattggccacatgtccttctgctctgtgcatgatgcatgcaaatgtcctggggcaaatcctttcctgtaaccaagcatatctccttcccgacccatcatttggcacaaatgacccaaatagtatactgataaactgcagaccagtgttctaccattgcttaggactacaaacgtatttcctaatagaagtggacacttgctgggccttgtaaaattttctgatactatgcgacacgataagggaacaaaggagaaaagtattgacagccatgctgtttaaaagtagaaaacgggctgggtgcagtggctcacgcctgtaataccaggactttgggaggctgaggcaggtggatcacttgaggtcaggagtttgagatcagcctggccaacatggcaaaaccccatctctgctaaaaatacaaaaaaattagtcgggtgtggtggcatgcatctgtagtcccagctactcgggaggctgaggcaggagaatcgcttgagcctgggaggcggaggttgcagtgagttgagatcgtgccactgcactccagcctgggtgacagagcgagactccatctctgaataaatgaatgaatgaatgggatccattttgaattccagagattctgatagagctggaattcaagtgggtggagcatacctgctagactcttgatggatgcttctctgcagctgagcatttcttgtatctagaggtatttttgaaagcttcctgagtataacaatcacctgggttgcctggacgctctggctttctgggccccttcccagcaaggcctgggttaatggatcatggatgcaggctgaacagctgtcactttagccagtctccgggtgattgttatcactaggcaggtctggggaaacactgcctggagtcatactgagtcatactgagcacaaatatttttgcctcagcgttctgggaatgcttaaccttgttgaaatgagaacacgtagagttttagcaaggatattttctagtgctttaaactcatggtactggagatggataaacattgccatagatacttttgtcagtagatgtgaaaaggcgtttgttcagtgtttataatgaaggaagaactgggatggtgggtggcaaggcagcgttggaggaagacaaagagtaggtttgattttttgtttccccttcaaaaatctgtcaaagctgtcctcagtcacataaggcacaggctgatgaaggcaagagcacatgggctgtgatgggaaactctccagatggtagacaactttcaacaccaacatattgttgttttatgaaggcttcatttatttgctgagctagcttgtggtatgtggaacaggatgtgtcttgccctgggcagttgagcgcttagtgtattaagggctctttatcctcgcctgaccccacatgaaccgaagaggtgcttgcatgaattagtacaggaccaccagggtggagggtggggtggagtgtgtgtgtatgtataggtgttgggggtaatgtgttatgaatagctggatgccaggggaatgttctgggaagtgcagtcagttctttgagcagtgtggattgcagttgcctcagggagctcttctgagtggcataagggagtgggtgcctcacagttggcccttctcggcaagtggcccatgggtccttcttgaagcaggactattctcagttcttctaatattagacatgttcctgtttgcctcccgagttgctctccagtcttctattttatttcaatgagagctgtcagtttttcttctaaaagcgttctttgaacactctgctttctttgagctgagttcaacctgccaggaactctgctagttccacgacaggtacaaatatcaaaggcaaattggatctcacaaagttccccgactgtatcttgcatttcagagttcagagaagtttctttaacgaaatgcaagaaagatggatgttgttgaagcaatttcagcagttctttgaagtgggtcctttcctggaccccagaagatgtaaattttttttttttttttcccctcaaaattaaatgaacatgcagttcttaaaatgacctctgggtggagctcgtggtactcacaaagaacactagcggcgttgaaagcttttatgcagctttctactccggcgttgtttttgaaaaaaaaaaaatttcttgccctttttctctgctgtcctcgatttgattgccttttaatagtcaacaagaaaggagagactttgcctaataattccttgaatcttagatggaaatctcccactatcttagggttttgtctttctgatactgagtagcccctgcattaagaaaggatttgcctgcatttgaagtggaggtgaataactcgcctgctcttcctggtatgacttggcactgttctttgggcatgtgttgtatgcagtgtatcacccaggcggaagatttctcatcaataatagtgcccacactgggccaatgctgagtcacttggcaacccattgggaaagctggaaaaatgttctgatttgtgaaagggagaagcttttctttccctcaccatgaagctctggaccgcagctaattacagagcctcctaagaagtgttaacctcagcattccatagtgaccgacctcctgaaccgggcaggtacagaaagctgcagtgttctgaggcctaataccttggcttttgtagcaatgacctcgtctcaaaatggaagtgtgtggatgtggctttgttgtactctttgctaggggtgttcactgtaaaagataaatgaggatgcctctgctcccgtgaagggtaaatttgttttctctgtctccctgccttttcctgctcatctcttaagaggtcacgagtagtttttgtattgtgaaactgatggtgtaggtttcaagtggaaatttagtatcgtgaaataagcaccgctttttgtttaggattctctgttccctgcaagcatgtgctcttattgtaaataagcagcaaaggacagggcatctgttatttttctggtgaccacagctgttgaatgagtgtcaggtgataaaataatgattttaggggtgtcttctggaggatttgcccttgccagagtagaagaggaggatctcaaggtcgctacatcaggattctgactgagacctggcaggagagcgtcagatcaggaggagcaacttcctgagcttggcttatctccagctggatttgactatatagccaaaaagctggatcccttcggaattatttgtttgtttgtgctctttgcccctgggacctaagtttgtcaggtcacatccaaagaaaaatagcaggatgggactcacagggaggtggcatcctaatgatgctctgagggagtggccttaaccttggccacagcaggtgcagagaagtcggctgaatggtcctaaatttattggcatgtgactctcacacacaggctttgagtgaggtggtgagagttttcttgcagagggcgaaacagaggtgtagcccacttctttggctttgtctctaagctctaccaggcctaggtactggacttctcccaggtatgcggtcagggctctgcttatatccggagcctggtggttctcaaggtgtggttccagaccagtagcagcagtggtccctgggaactcattagagatgcaaattttcacatccccacctgctgagctctgggagtagggctcagtgccttgtgttttacctggtgattctgctgcgtgaaaagggttgggaacccctgtcttgtccttaccacttcacagcacacctgcctgacttccaactgcagcctcctgcattttggccaagagcattctctccctgctacagcctgctttgctactcataaagagggcccaaaggacggggaatgaccacaccttcctcagaagtcctcacccaacagttgatgggagttgctgtgtgtggcccccgctccctcatccctctagtgcgtgttccacatgggctctgggagcttttccaatgggctagagctattatactagctaagatactcgttgctgactgcctttctttctctacatatttcctctttctcctaccagtgtttcttttgctgcccaaatgaactgctcgcacttgaatccttgtcttagagtctgtttctgggggattcccaactaggacacagcccctgggggtatacgctttcccagtgcttccttgcctgtaaggcaacagcacatttcaccgagtctggttgctagcactgcttcagcagactcaatgccacaaacatttctagcacaccaacagcatgccaggtgctgagccgggattcggactcagagatgagcagccacagtcccttttctgcgggggccttcaggctcctaggagagaacaggaggccatggatgcagggcagaccaggagaagtgttaggtaacgtgatggagacgaaaggggtcctgggagtctaggggagctcaaacatgacatgtgagggtgccttacttgggaagtgcctactctgcccctttctctcttcctctgtggtgttcccacaccctgtcttgcagccttgtggcaagtcttcctcttccttccttactaatcccaactctgcatctggctgtcacttccccttgataccttcactcctgcttcacctcactgtgcattttaaattgtttcgtaggagaaaagaaacagaagggctttcatcaaactgtctcctgccctttccagttacagattctagcacatttgcataaccgctcaagaatgcagtcaccctgcgtctggcatccactccagggctcaccagggacagtgactggtagaccagcatggaaaccgcgggctgtggctccctcccatgtgccaccttcccgagcttgtcccttctctttggctctatgtctctctcacacacatgcaggccaagatggcggccttcatacttgtatctctttcctctcactggcctcaacaggaagtatggtatagaggtcaggagtatagacaggtgagagactgcctagtttccaagccaacttctacaccttattgactgtatgaccctttggaaattacttaacttcttccaccctcagttttcacatccataaactggggagattggtccctgtctcagaagatttgttatgaggattaaaagagccactgtgcctaaagtacttataagaatgcctggagcatgagaaaggctccccaagttgtcagccgtttggtccaaactgctgtgcctctgggaggggaggctttggctggaccagacggtgagaggagggatatttgtgagcagcccctgctgagagggtgttggaggggatgcatttcttttctctggattttggattttgtggttttgaacaaattcagtattgtcgttgtgatatatattttaaacacaaaagtaaatatctggtataagtgggagtttgatgcatatatctatttattttttcgagttaaagtctcgctctgttgcccaggctggagtgcagtgttacaatcatagctcactgcagcctgaaactcctgggctcaagcgatccacccaccttagcctcctgagtatctggaactataggtgtgtgcccccacccaccttagccttctgagtacctggaactataggtgtgtgcccccacatccagctaagtggttttcttaatttttttttttttttttggtagagatgggatctcactgtgttgcccaggctggtctcaaactcttggcctcaaccgatccgccagctacagcctcccaaaatgctgggattacagtgtgagccactgccacacccagccaacatatatttattaaaggcatagtacatgtgatatcttaccggagtgattttccatgctctagagcctcatgtaaatgtcatttagggggatgctttaggtcattcattctcacacttgagcatgcatcagtgccatctgaagggcttgttaaaacaccaattgccagccccacccctagaatttctgattcagtagtgctaaggtggagcctggatatttgcatttctgacaagttctcaggcaattctgatgctgctggtctggggcctgtgctttgagagctctaggtgattacaagtgaaaatgtccttatgccaagcctgtgttaatagaagggtataatgttcattaagtgattgtcttacctcttactggagtccccttttcaccatttctcgcaggtgggtcccctgagtgagtactaggacacccagaacccagccaggccacctactctactgttgctgtctctgctaaagagccctgcttgagagagatccaaaggctctttcttggtcatttctgctccttgactccacatctgtccccaggaactacccaggttaagtcttccacataaaagcccttccaacgtttgaagatgtttaaatgtttttcttttttctttattttattttatttatttatttttttcgagacagagtcttgctctgtggcccagactagagtgcagtggtgcaatcttggctcactgcaacccctgcctcccgggttcaagtgattctcctgtctcagcctcccgagtagctgggaccacaggcatgcgccaccatgcccggctaatttttgtatttttagtagagatggggttttgctatgttggccgggctggtcttgagttcctgacctcaagtgatccgcctgcctcagcctcccaaagtgctgggattacaggcatgagccaccgtgcctggctgttttttctatttcaaataaaacacctttagtgtttctcacattaaattaaccaacattacagtcagactggatgttctaaatgcttcacaaatattagctctctcaatgccataatatccgtatgaggtaggtactttttttttttttttaatacagatgaggaaactgaagcacagagagtgtgagcacacttacccaaggtcacacagctagtaggtagaagagctgggattccctccctagaggtctggtttcacagtctgtgcttttatccgcaatgccagtgggtctcaaagtgtggtccccagtccagaagcatcgccatcactcaggactagctaaaaatgcagattcttggctctatcccacatctatagaatcagcaactctgggagaggccctaggcatctgtactttaatcagtcctgctggtgattctgatgcagcccaagtatgagaaccattgctctaaggtgtggttctgatgcctcatcctgctggctgctctccagttttcaatatcttttttagaagcttaagttcaaggctgtgcacaatattctaggtatagtgtaactcacacagcacaatgggaatattattactgcctttgtcttgcatacaaattatattaagaaatccaaagtttacattatggctatcttttcccctcagccattcactgttggctcataacgaatttctagtcagttaatttctaggtctttttttccccgctcacaggaactgttgttaagccctgttgctccagtcctaaacttggcattaaaaaacaaacaaaaaaaaaaaccctcatcccagaacttcacatttattcttattaaaatccatttagttgttttggttcatggctctggctttcaaaaagtatatttctggacctcctacatgtttattattgttttaaaaatctatgctcatttaaaaaatctggaaaataaagcacaacagtagaaagacaaaaaaaagttctagttccatcatctaaacataactgctgctaacattttgatgtatcactttgacttttttcccatacataggctttgaaaggcattcttgaacaatgatgtttataaaaatttgagttcttttttctcttaacatttattataagcatttcttgtattattgcatattctttatgcaagaatattcactgttggctgggcacagtggcccacacttgtaatcccagcactttgggaggccgaggcgggtggatcgctagaggtcaggagtttgagaccagcctggccaacatggtgaaaccctgtctctactaaaaatacaaaaaattagccgggtgtggtggcaggcgcctgtaatcccagctacttgggaggctgaagcaggagaatcgcttgaacccggaaggcggaggttgcagtgagccaagattacgccgctgcactccagcctgggcgacagagtgagattctatctctcacacacacaaaaagaatattcactactatgacatattcttctagtggtggcacaggaggtactacttaaacatttctctatagttgcatgtttaggttgtgctgttatagttattactatgatacacatcttttgcataatgccttctccctaaatgtaggactaattccttagaatggcatctcagacaacctttgaaaaggtcaactctttccttcagtatatcaactactgtttctatgtcgttcataacttgataagtttgttttttagttttattattttggggttattatgaatggacatgctcaaaaaaagggaattggaatcagccaatttgttcatcctttggcaatgcccttccagatttatctattgaacaaaaatattcagggagaaacttctaagtggtgagtcttttgttaggtgccagtcaattcactaactaatagatttttggtctagttgttctactttggacaaactccatggaactatgatttaaattctcccttttgcctgcaaggagaccttgagatatttagcaatgcgttgatatcatccagttatactgtatttagggcattctttaatttaccaatgtattgttctgtttaaaatgtggaaacctgaggaaatgaacaaagcttcactgggttctcatttttctgaagttccatgttacctaagtgcagattatatcattctgtgaaaacagccagctgttcaggcaaccaaatcagaaatctcagtctttcctcttagccaacttgtaagcacaaatcgtgttgcttctttctgccagctctcaaatttataccatttctgttttagttattcccctcccttagcttctcatccttaaacattttttttaattgaggtaaaattcacctaacataaaactaaccattttaaagtgaacaattctcaattagatagaagaaataagctctcatgctcaatagcagattatagtgactacagttagcaacagtatattgtatattccaaagcggctagaagaaaggacttgaaatgttaccaacacatagaaataatgaatattcacagtgatgggcactccaaataccctgacttgatcattacacattctatgcaggtaaaaactactcacatgtacccataaatatgtacaaatattatgcatcaataaaagaaaagaaatgaagtgagcaattcagtggcacttagaacattcacagtgttgtgtgatcaccacctctatccagttccaaaacatttttgtaactcccaaaggacactttgtacccattaagcagtcactctccattccccactcccccagctcctgacaactaccaatctgctttttgtttctatggattcatgtattttggatatttcctgtgaatgagatcacgcaccaatgcgatttttgtgactggcttctttcacttagccttatgttttcgagactcatccactttgtagcatgtatcttctcattctgtttaattggcgtccccattgatagtcttggaaaaggaatagcaaaataaacccctgtagcatttctgatagtgagatctttcctgtcttctctgaactttttgcaatagcatcgtagtgtttattcatagctgaaatactatcccccagctatatattactgaattgaagcaactcctgtagggaaagaagtatgtctgactactttatttttgtattttcagaacctaatgtggatctgacactccattctttgaccactgggcagaacttagtaagaaccatggctttaccaaacactagctatgggacctcaggcaagatgggcagttttgggggtctcagtttcctcactcatgaaatggggacaaatacttttgtccctatttttactgagtggaacaattaatatatgtgcagtggctagcacagagtaagtgctcagtattagtaagatgacatgttcatttttttttcccaagtttcctctaactgcctccctcactaaataacatgctccattatagtgtcttaaaattgggaatgaaaaagtgatgccagttacataattacattgttttctttggggcagaggtacaaaatagaattttattaaactttgcctctaatatttaaaaatatttttatggaaatttaaaaatgtacgcaaaaatgtacataactaatctccgtatacttatcacccagactcaacagttagtaatattttatcatgctgatttcatctactcccctacttgtttttatgcttgagaattttaaagctaattccatctatgaaatcattttactatgattccatctctgacaccattttactataaatatttcattatgtatctccaacatataaggaattttaaaaacctaactataataccattaacatacttgacaatattaacattaattccttattagtatcctgtctgtgtgcagtttcctataattatctcaaaattgtttgctttcttttttttgaaaaaaaaaaaatggttgatttgaatcagtatccagatgaggtctgcatattgcagtcaataggtacatcttttaaagctttttaaattttaagagtaccgcctctccatccatgaaatttatttatgaaataaattgagtcatttgtctggtagaatttttaacaatcttgttttgctagttatttcttaatgttgtcttttaacatgttgttctgtctcttacattttctgtaattggttctatctagaggtttgattagattcaggttcaattttctttggataagaagacttcataggcagtgctgtgagcttcctgttgcatctatcaagaggctcacaatgccacgttgtcccacttgcaaagcgaagggcgatccgtgtgttcaggtgttgtcagcctgatcctttcatttgaactttcttaccattcctcatgcagcagtcctgtttcttggctgtacattagaatcacctgggaagctttttaaaaatcctgaggctcaggccacaccccatatgaagatcagactctctgggagtgggacacaggcattttctaaagttacccaggaggggcccggcgcagaggcttacgcctgtaaacgcatcactttgggaggccgaggtgggtagatcacttgaggtcaggagtttgagaccagaccagcctggccgacatggtgaaaccccatctttactaaaagtacaaaaattagccaggcatggtgtcatgcacgtgtaatcccagctacttgggaggctaagacaggagaattgctcgaatccaggaggtggaggttgcagtgagccaagatcatgccactgcactccagcctgggtgatagagcaagactctgtctcaaaaaaaaaaaaaaaaagttacccaggagatacaaatgtgcagccaggcttgaaaccactgacttaattgtttcagtggccattgataatatttcattgattcgtgattccattcggtgttgcaatgtttgattttcaaattctatcattctttttgcatttattagctaggctgtttttataaaaaaggattttccctcatcaaccacttgattactctgacatatagtttatacaggaaagacagcataaatggctatctttctcttgattaattttcacaagttggtgccctaagcacttccagaggtgccaaaatagttttctttttagtatcaccaacttagggaatcttatgtatttgatgtgtttaaatttgttatgatcatcattcactgaagctcagattgtcccatcttggccaatgtggggctcttcctttagtgaattttgacatgaccctagttgtttttgaaagcatctttgcctcctggcacaagatattctctttaatgtttaacctctatttaatcataagctgttttgaacaatttgtaaatcagtgcctaaattagttctcccaccaatgaacagtatattgatttttttctgatggggaaagggtagcaccttactaacttgaaatacagcattttattaatgagcaaatttgcagaaatatctgttagagactgatgtaaattatcttttgtaaggggcagtagcttatatcaatagaaacacacgtaatatgtactccatggtttttgaaaacctctgcagtgttgcattttcagtgttgatcatcaagaatacaaatatataaccatgtcatacattttaaaaacaaataatgctagtgttgaggaatataactaatttcaaatttgtggaacagtgggactatattaaaagatgagtctgggtgtggtggctcacatctgtaatctcagcactttaggaggctgaggcaggcggatcacttgaggccagaagtttgagaccagcctggccaacgtggcgaaatcccatctctactaaaaatacaaaaattagctggacgtgttggcacgcacctgtaatcccagctatttgggaggctgaggcaggagaatcgcttgaacccaggaggcagaggttgcagtgagccaagattgtgccactgcactccagcctgggcaagagagtgagactctgtctccaaaaaataaataaataaaataaaattaattaattaattaattaaaaaaataaaagacgaaacttggaatagtaaatacttaaaaattctaacaatatcaacaggtagtgatagtttaaacatgtactgtaaaagtgtttggtttttaagggtatgtaagagactggttgtctgtgggactttgaaagcagttgggaaatgccacaatagcctcagtataaaattctagagacccaaagcggagagagatgcctcttaagaattatggaggatatttattacttttattcatgggatgggtggtggtgatttaatgcctgtctcttgtttcttttgtttttttttgttatccaaatccaaatccaaattatatgaggaattcacttaaaaatatacgtttagtttggtttaataaaaataatcagttttgatgtattgacttttaatttcatgggggaaagagtccattaggaatgttcaggctttctgtgtatattttgtgttgctcattctctttggcccaagatgaaactaatagccacaatgtgtctgctttggtgctgtctctagggttgtgtctgctgctgtcagctgcacccttgttatctggctgctggtcctgctcagtcagttgtacaggaatgtcatttccattaataaccccagggccggacaggcagatagtggaaaatgggtgaagagagagaaattgtatttaacccagtgttctgagttgtcatttttgagaccctagcatagctgggtaaaggcaagcagagggcatgacagcaaatctatttctggcagaatctcatatacaaactggagaaacagcctgataccaagagaagaaagggtgaaatatactgggaaaagagggaaagatttggggttggaaaagtcagaggaaacaatgttaggaagaaataacatgatcaagtattctgatagaggtgctgacaactttgcaaaataaatttaattttgattgtaaatgccatcatttgtggtggttcaaatgaacaaaattcctttttaaaaaatgaaatttatgtaaggattgctcatagaagattttggagttttgtgctatgtttttttttttttggttctggatcagtgaaaggcccgaggaacagagtaggttttatttttttttccatctaggtagaatgactcagttactgtagttgtctgtgttttggttatttattgctgcataacaaattaccccaaaacttgctggcttaaaacaagtattttattatttcctatgattctgtgggttggctgggctcagctgggtggctcctctgctggtttcacctggagtcccttaggcagttgcagtcagatggtggctgtggctggacgtccaaggtggcttcttcacacatgtgtctggcacctcagtgttcctcatgtggctttctcaacagggtgctgtggtactcctacagggtagctaagagtgccaagaagagaaagcagaagctgccggtcctcttaatgtctgttctcagaagtctcagaatataattgacaaataataattgtatatatatttttggggtacagtgtgatgttttgatgtatgtatacattatagaaagattcaatcaaactacttaacatatccatcacttcacaaacttatttttttggtaagaacattaaaaatctattattttagcaattttgaaatatataataaattattattaactgtggccaccatgcagtacaattggttactaaaacttattcttccagtctaattgaaattttgtgccctttaatcaaaatctcccctttccctatctctccccctccctccagcctttggtaactactttctactctctgtttctatgagaacaactttttaagattccacatataagtgagattatacagtatttttctttctgtgttttgcttacttagcattttttttctatttttctgtttggttgattaggctatttttcattattgactgaattatttttttctgtttagctcaagaccattgtatacatcgactcacagaagtatttgagtaagcctaatcattgttgaactgtgatggggaaaggattcagccttgggacacgtgacctttgtgtacaggtgtaagaaattcctactaggttttagggcccagaactggactaggccatgagggacccaacccatcctagtaggcaaatcattttccagttttatatttgagttcattagtaaataagtttactttccattatagacaccccctccactgacttatggggtcctgtacgccataaccaaagactcagtgttggaaaggtgatgctccactctgtgtctttgtttagctaaggtgaaggggacaggtctgccaccctggtatattctggtattctctcattggcagtcttagtgaaggctcatgagagcttcctcacagaggtttgtaaggattagaactgagtggaatagacctgttccagggcagagtgaagccgaggacaacagtgagattgtgtccttcagggccacagaccagaacctttactcaactctgatgttaagctataaagctagtttacaagtttatggaacaattcagcttgttcttccaggctcttgaaaatgaaggttaaggctgggcccgtggctcatgcctgtaatcctgtaatcccagcactttgggaggccaaggcgggtggatcacttgaggtcaggagttcgagaccagcctggccaacatggcaaaaccctgtctctactaaaaatacaaaaattagccaggcgtggtggtgcctgcctgtaattccagctactcgggaggctgaggcaggagaatcgcttgaacctgggaggcggaggttgcagtgagccgagatcatgccattgcactccagcctgggcgacaagagcgagactccgtctcaaaaaagaaaatgaaggttaagttttggcaaagtgatttgtatagatctgtaatacatcatgttctaatgaggtccaatgagttctaagtaatttctgatttccattaaaaatgattcatgaaaaaataagaatctcatcagagagagagagagaccacttttgaaatgaggaaaaatgacagaatagaaaaggagaaagtctcttttctctcttcttccccaagcccccctcatcactggttacttatttgagcatcctttatcagcatctaatgagaatgagaacatagtgggatgccatgtgaccttttgagtaggaattggaagctcttatgaagtttccagcctgatgtcacttcagatccaggtcattaatatttaaaaaaataaaaaaaataaaaactcttaggtgattcgaatgagcagccaagtttgagaagcagagccctactggagcaatgcttctgcaacttgaatgtacatgcaaatctcctggggacttggttaaaaatgcagattcttaataagtttggaggggagcctgagagtctgcatttctaacaagctcccaatggaggccgatgctgctggacaatggcctatggaccatactttgagaatatagagcagggggcagcaaacttttcacatatgaaggcctgagagtaaatatattgggctttgcaggtcatgtggtctctgttgcagcaacccaaatatacctgtagtacagagcagcaataggcaataggcaaacaaatgggtgtggctgcgtgccaataaaactttatttacaacaccaggcagtatcctgaatttgtcttacaggccgtgagccaataaaactttatttataacaccaggcagtatcctgaatttattttacaggctgtgacttgccaacttggtctagagctttccctgtctcaagtttttgagccgtatcttgcttcttccctgttttgttgggctgaatcttaggtaagaattaaatggttttgaaagaggttactcaatggctttgttgaactgatgaataattgatgatgacatttaggctctgtttacaaacagccccaattgtcccttggttgtggctcattgctttgccttgaatataggtggcctttctgatttctctccctagactgcctcttcagcaatggatcgaaacagagctagggtttattctaaaatgtggcccacgggcatctcagaataaataaccaggtctgaactgtagaggcagagggtggcttcaggtcacttttccttgacctgcattttacaactcatctctggtgttttgtctaaggcgacagaggctggtattttggctatctgagaggtagagagcagagaggttcctggacatgtacattttgtgttgagataggtcatgccccagatatggctattaatggtagcagagagttaaatgttgctgataatatattctaataagtagataatacagaaccaagttgtcagagttttggggggacccaaatttggaaccaaggactcaaagctcagaagggttccatcttgtgggcttcaggagtaaggtgcaagattcctggtctgctgctcatggtaaatttcctgcatttcaaaccccaaagtcagttaggcctaagcttcaggaaagttttcagtttaattggttcaaaactgaaacagactctcatctatctttatgacagtgctaggattcctaagggagaggtgttactcctcttctgaaatgggaggatgtgggccaggaatccttgggccagggatgcttatggcagactccatttctcagcatggttttggctgggaatttcctctatgagattgacccttctctccccgaggtgccattttctggaataccaccttctctctgctggtaaaatctaatttaccttagtgccttgactggtctgcaaaataaatgttctgacgtttcctgacaggagagcctgtcctctctgctttctgcttctttatcattcttgtactttcttgccttgccttttccattttgatcttctctcttggccaagtcttgtcttccgggggctctcagtcaaagtttagtcccaccgatgtccagaacagaaagctcagtggtattatttttagagagggagggagaacctcttaaaagcatacttaaaattctatctgtgtgtgtcttttcatccttacatctgagaatattatttgtcttggcatgttgaatatggttactaatgcagatgtggtctgtgccttacatgttattcagtttgatttataaaaaatgaataattatataatagaatatttaatcactcagaagataatatatgttgggaaaacatgaaatttgaagtcagattaaggctaaattaatctaggtgagaagttggttttggccctcattgcctgtgtagacttggggtgagttgcgctcattttctgagtcttagcttatgagctgtgaaatggggatgatctgtacctaccttgtacagttagggtaggatttggatctgatgatgaagtaaagtacttagcacagtacctggtttatagtaagggtttaatggagagcattacttttgttatttaaaaaattatgtctattgtttctgtttctgtttagctctgagatctcctcctctttgaaaatgtcctttccacaaggcccttcccttcccatccattccatctgaccctctaccttcttctgttgttttttctcttacatcgcattctctccctatgaccaactatgaactcctgaaggaaagaaatccagtttattaaactgtgtgtcttcactccgtctaaacacaacaacatggacaaatttcacagatgtgttgttgagtggaagaagccagatacaaaagagtacacactttttttgaagttcaagaacaggaaaaagtaatttatggagacagagatcaggatagcggttcttttgaaggtggaagggttattcactggggaggtacccaggggagtcttcaggatgctataaatgttttaaatcttgtctcaggcctactaacacagatgtgtgtatgttttaaaaaatatttgattggtatacttagtatttgtgcactttgtacgatatagtgcagtaaaaattttaaaagatgtttcccagtatgcagggcttatttgccttttagtgatcattcagtaaaaggttgaatatttaatggatgtcatgatgaagtaaatgatcaacttttttttttttttttgagacagggtcttgctctgtcacctaggctggagtgcagtggcaccatcatagctcactgcagcctcaatctcctgggctcaagagatagtcctgcctcagcttcctgagtaattgggactataggcatgcaccacaatgccaaactaatttatttttttgtaaagatggtgtctccctatgttgcccaggctggtctcgaactcctgggctcaagcccccaccttggcctcccaaaatgctgagattacagctgtgagccaccgtacctggccctaagtggttaatcttaatcaccatgtgaccaagaccaaattttaaggaagatgtagcatacattttggaaaacatggtagacataattcataatttatagccagaattcacgctgttgttcatggcgctacttggatcttcacatagctgtttcagaaaatatagtaaatgcgaacggcaggacttgcaatttcagacagtttgtgcagttggcaggacagagaacacagagtggggatacggtcctgtcagattggtggaaaacctcatttttaattgattgtctattgcatctatgcccctcttttcccaccctccctttgtccttttatcaattctacttggaaataaaatctgcaactctaatagatgctactgacactcgtgcagcaattctaccagatggcattcgaatctcgggtgttctatgaaaaatgaaaagaccaaacacatgcacaaataaatgaaggttgaattaatctttataattaaacggaatattaccctgctatgactgatttttgctttcaaactggattgcgtgctaatttttcagtgaactgtaattgtattaacatggcttttttgatgcctgaaagtacttaaaaatagattttgcgaagttactgagagaaaagttattagaacttttaatctaaacatctctaagatcctgaggtatatttatatcacgacttacagctgcaaagcattttccaatagttttttattctttgtcccttatcatcctgggatttaggtggcactggccagaaattgggttgaattgcaagtacctgaggcacgttagaaaattgatgtcctactgtgtacccacaaaaattaaaaataaaaattagaaaacaaatatgtacaactgctatgtacccacaaaaattaaaaattaaaaaaatgagtgggagggaaggtggtagagttttctacataaagtgcacctactagcttagtagtggtgactattagtgaaatccctaaggattattgaagcagaggatgagtcccctacttatgaactgataacacagtgttgggggttctcagaagtgggtccagaagccttggtaccatggcaagtaccatgatctacagcagagagtatctcaaatttcagcaggcatgagactcccctatagtagtggttttcaacccagagtgatgttacacacctggagacatttggcaatgtctggagatatttttgatcacaactggggggacagagggtgttactggcatttagtgggtagcagccaggaatgctgctaaatatcctacaatccacagaacagtccccagagataagaatgattctttcccaaatgtcaatagtgccaaggttgagaaaccctgccttatggtaaggctcattataatgcagattcctgggtcccagttcagaagcattctaactcaagagatgtagcattgtcccacaaatttgtgttttcaacaagctcccacgtgacacagatgctgccagtccaaagacaaagctttgggaagccctaagctagacgatgccagtgtcaaaggaacaagccatatatgtgggcactggccctatgacattcccttcttttagaaaaatgatatgaaaattcccacttgcattgattgattgattgagacggggtctcgctccgttgcccaggctcgagtgcagtggcatgatatcggctcactgcaacctccgcctcccgcatttaagcaattcgcctgcctcagcctcccacgtagctgggattacaggcacacgccaccatgcctagctaatttttgtatttttagtagagacgaggtttcaccatattggtcgggctagtttcaaacttctgaccgcaggcaatccacccgcctcgacctcccaaagtgctgggattacaggcgtgagccatcgtgcccagcccacacttgtctaatttaataattcaccaaagttatctcatttgatctctccccaccagtttatgagggaggtacttcacaaggtttttaggtggtaaagaattgttcatataagagctaaccttaaaggaaagaatgacaacaattcccacttaaactgttgatgagacaaggggatatgtttatctaggttaatctccaacttgcctcctgtttaaataagtaatttaacaactggaggaggattaagtagctgattaaatttctctgagaaacgttaggtgttagggccttggtatttattgcaggtgtgtttctaagccctttcaaccttgatatttgaaaatgtttttaaataatttgtaagtattttttcccattccccaaaaaatgcattgatttatttcatagtatttattcccattttggttaatatttctatactggctgtgttttaaatgtagatatttacctcaacaaaatatgaatattacagctaattatagaattatttaaatagttattatttaattatatatttctatcttgatgaaactttccgaaaagattaacctttgtgccttatttttcccttgctatctttactattggttttgaaaaatggggaaacctcttgtgtagaagaggggttggcaaaccatttctgtaaagagacaaatggtaaacatcttaggcattgtgtgggctatatggcttctgttgcaactactcaaactccactgctgtagcatgaaagtggcagtaaacaatacttaaatgaacgtggctgtcgtcagagagaaaaaagcaacttttcctttaccactttaggtttaatgtcagggcctgtgaattaaactataaaagatggattaacaagagaaaagcaaagtttattcactaacctgcatgagagcttacagaaaacacagcccagagaaacagaattggggggttacatattgtcttaagaaggggtagggttaggattttaagggacaataaatggtgggaaatgactgagaaatatatgaggggacctaacagaaagtcaggcttgctttagtaaggtctgtttatgtaagttctcatcctggcgccaactttttatccccggtgagaggagttattttcccccggtgcaagaagtgtctcttaaaagggggatttacgacagttgaattcttttggaagtctctgcttgtaggccgataagggaagcatggagaaagcctctttctgcttgtcttgattctcagataccttcagctcaaaatagtcctttgctacagtagcatattccggaccaataaaactttctttacaaaaaaacatgtggtaggctggcttgggctgtagtttgctgacctctgatacagagccctgtgagtgagacagagacaaacataatttattttggctcatataaaagcctaagtgtgatataggattgttcccactcttgggctgttatcattttggttatgtctggataaatgggcttagctaattgaggcttagggtattcatttgactaggtctagcagctgttctatttgcaaactttgtgagcagtttaaccacatataatcgaaaccaataaaaacattgatttaaaaatttatgatttggccactcttctgcccagtttcttttcatctttttttttttaatttaatttttatcatttgggacagggtctcactctgttgcccaggctggagtgcagtggcacaatcttggctcactgcaacctctgcctcccaagttcaagtgatccttctgcctcggcctcccaggtagctgggatttcaggtgcaagccaccacgcccagctaatttttgtatttttagtagagacagggttttaccatgttggccaggctggtctggaactcctgacctcaagtgatacacctgcctgagcctcccaaagtgctggaataacaggtgtgagccacggtgcccagctcctgcccagttttaaaggaaataaatgagccgggtgtggtggctcacacctgccatcccagcactttgagaggcagaggtgagcggattgcttgagtccaggagtttgagacaagcctggacaacacggtgaaaccctgtctatattaaacaaacaaacaaataagggaaataaatgagagttgcctctatttttaaggtaatattgctaccactctaaggacgatgggtgtgttgttttattaattaatcataaggtggctttggcttctaaaatctattgctactacctgctccatctgtttaccaagaaaactcaaatattactttctttctttaactctgttcagtacagggctcacccaagtaagaggagcatcacaaagacaccagggaaatgtttagtgccagtatggcaaaattaagatttacttctgccagagtagtttccttttgcagacagaagaaactgcccacctccaaaatatattgagttggtgttttaggagagagcatggatggtgcttgtttataatttggaacatgccttcctagaatgttgtctatcttagagagtaatgagggttttctgctatactggggcattattcacatggggttgagggtggatgacctgaaatctgatctttcctgtcttttacttcttgtacaattagaactgtgatttgcacttagagagccttctgattcatggaagtgcttatctatcttctacccctgtatgatgcatctgcttgtggaccgcacccaaaagcaatttgcagaattaaagtttttgaagactcataataaatcagttcaattttatcaagagaataaaatttgattcatcagataactgcattgttattatttgtgggatcctgatagacccagaggatattaaagcctgttcccctgactaattttcatcaataccattagctccgcttagggtaatatcttcagctaaggcatctatactagtcaatcatttgtttggcattatggaaactgccattgttttgaatgatagtgtaattcatgtacagtctcctgaacttctgggtgcttaaagctcagaattttgattgatgtttaatagttattacagaactcatcagagaaaatgaggccttggcatgattgagcctgactgaagctttcaaagccactgcaagcttaggaaagttgccctataaattttttatgaaagggcagtgatcagttgttccatttttttcttaagttggttaaattaataaaaaagaaaaaatatgctgagacttaaccacgtatactaaacatacagctatttaattaagtgattaaagtggtctctttgatgtgatacatgcaagacatttgagaatttatctgactctcctaaatagccaagtcagtggggattaaaataaatgagctttctgtcttcctttctgtagatcagcttaatagtaagtggctttgaaaattcaggagtaaagcagtcaacctagccaatctttaaatcagttcagtcacatatataaaaagtagatgccatttcagagctcacagctaaataaagcagaattatgcctgattctgttcttcccaccagcattatcaagttgtagtatacagtattgaaaattctgggaaggtgggggtgatttgagagtttaaatcatgttgtatattaggttttcaatgttcctcatttttctgagttcatttgtgatagctgttgtttctctcttcaaataataatctttacaaactctctgttgtctccatggaaattaattgtgatttttaaagctctagcactaagactttagggcagggagtcaactcccaagcaactgagatctgtcgcatgtaaatggtagtaatagcaaagagcaaagcaaaaacaaataaaaatcttgatagctaagccgtgcgtgcacgtgcacacacatgcacacagatgatgctgttgagcatggatcagtttggaagcattgttaagcacttactgtgtactagcccctgtgtcatgaattgaggcaactcagcgaataacctagctttatttaattatctgtgttggcttagtaagttatggcccttgggccatatttggcattctgcctgtttttgtgtgaaccacaagttatgaatggatttcacattttttaaatagttttaaaaaatcagcttggcacaatggctcatgcctggaaccccagtacttagggagggagatgtgggaggattgcttgagcccaggagtttgagacctgtctgggcaacgtagtgagacctcgttctccacaaaaaggaaaacaacaacaacaacaacaacaacacaaaaggacaaaaaaacacaccaagtgtaaacaaccaaaagaagaatatattatgatacatgaaagttgtatgagattcaaatttcagtgtctataaagttttattggaacagagtcacagccattcatttatgtgttgttctagcttgtttctgctttctcaggtacaatcacagagctgagtagttgtgcagaggccatatggattgcaaagcctaaaatatttactatttggcactttacagaaaaagtttggttattcctgatatgggtaaggcaaacttcataattcctttattatctgaatacttctcccaactctctattttactttattggtattagaactaaatgtatccatattctacagacgaggaacctgaggaacagagagattcagaaaattcagctattgctaataccttatgtgatgatgataacttgttatagaatggttttcctcagctttttaaataaaaatgcagttaagtaatcgataatattacgtttgtatgttctttcagcattaaggagagtcctgagccttgattttatgttcagtatgtgtattagtctgttctcatgctgctaataaagacatacctgggactgggtaatttataaagaaagaggtttagttgactcacagttccacatggctggggaggcctcacaatcatggcggaaggcaaaggaagagcaaagtcatatcttgcatagcggcaggcaagcaagagaaagcatgtgcaggctgggcacagtgtctcacgcctgtaatcccagcactttgggaggctgaggcaggtggatcacctgaggtcaggagttcgagaccagcctggccaatatggtaaaaccccatctccactaaaaatacaaaaaattagctggacatggtgtgggcacctgacatcccagctacttgggacgctgaggcaggagaatcacttgaacccaggaggtggaggttgcagtgagctgagattgtggcattgcacttcagcctgggcaacaagagtgaaactccgtctcaaaaaaaaaaaaaaaagaaaagaaaaaagaaagcaagcatgtgcagaggaactccccttcataaaaccatcagatctcctgagacttactcactatcaagagaacagcacaggaaagacccaccctcatgaatcaattacctcccactgggtctctcccatgacgtgggaattatgggagctacaatttgagatttgggtggggatacagccaaaacatatcagtaagtatttgctgattgattgaaatagcttacataaaatatatagttttgtttgccaccaagaattaattgcattggaagctgagtgtggtggctcacacctgtaatcccagcactttgggaggctgaggtggacatatcatttgaggtcaggagttcgagaccagcctggccaacatgatgaaactccgtctctactaaaaaatacaaaaattagccgggaatggtggtgcatgcctgtaatcccagctactcggtgggaggctgaagcagaagatgcttgaacccgagaggtggaggttgcagtgggctgagattgtgccactacactccaacctggttgacagagcgaggctccacctcaaaaaaaaaaattaattgcaatggattttatatcttgcttaattttccagaatgttttatatgttctcacaaaatatctcattttctccccttttttctctcctgtggtaagatcagttaatattgaaatataccttaatgttagctgggcatggtggcacacgcctgtgatcccagctacttggtaggctgaggcacaagaattacttgaacctgggacatggaggttgcaatgagccgagatcgtgctactgcactccagcctggatgacaccgtgagactgtctcaagacaacaacaacaaaacccagggaaacgtaccttggtgtgaacagcactgaatgatgtttatgattgtatgttaatcctcttatatttaaaggttaaatgtaaaatatagccttttatattttctgatactcttgatgacattgatcatagtgggtttatcaaattattcattatatgaattaatatttattgagtattggtcacttgctatgttacctgtggtaacatggtgattaggtggaataggctattggtttaatttgaatagtattagaagattctctcagctacaaaacctctcatttaattgtatttattcctttggctaataaactactcttttaaataaaagtatttctccagagtaaatatattagattgctattagtgacttacattctattataaactagtttgaggccccagtggcagctagtggattagcaaccttgaagaattaataattttgatggatgagaagggaagggggagatatctttggagcacagagtattgctaaggaaaggccaactagggtacgatggtattgcaagtggtatgaacacataggacctgctaggtgttgaaaggaacagataagagaaagagaaagaggaggaaggcagaaaccaagatggcaagtgctaaaagcaacctgtatctttgatcttttctagggttagatttggtagtgtttcttgtgtctgttttcagaggtgtgccaatagtggctctcaaaagagtcctccaacttttggggggctgcaaatagcctggattcttttgactcatatgcagagtctggctttgctaggaaaatctcctaccatgctccaagaagcttgtacatttgtcttccattgataagagggttgcctcaatagcttttctccctaagcatttcttttctcgatatttttcctctcaccacaagtgtggccttctgaaactggacctatgactaaaagagtgacattatttctcaggggtttcaggtgtttggttaggggtataagatgacctggactcttctggaagacctccaaacactacacatcacagttactccaaatccttggaaaaagtcacgtttctactttcttggtgtagtctacaactaacatttgctcatcatgtactctggaccaagggaaaaaagtgttttacatgcaatgtcatcctgaactcttgcagacaatgctatgaaataggtactaatttttagtaatttttttctcaacatctgatgtaaaggagagtgtgttaggattacattagctaatggaaaacatgacacataatgcctcaaacaaataagggctttattttctgtatgtcatgaagggaaaagagggaggcagtccaggtctaatatgctggccttcgaatgccatcagcttttcatcccaccatcttcagcatgtagattttttcctcatatgtgttgccttgtgattactagatggctgctcggcttctggcattgcatcagcattccagaaaggaagaagaggaaaggctaaagcagtagttctcagctggaggtgattttgccaccaggggcacatttggcaatatatggagatatttttggttgtcacaacttgcggaggggggcatgggttgctcctggtatctaatttgtagaagccaaagatgctgctaaacatcctacaatttataggacaaaccccagagcaagaattatctggcccaaagtgttgagaaaccctggactcgaggcagaaagcatatgctgatgaatctgtccccttttaaaatggatcattggaagtgcaacaagaagtttttcttaaatgtcattggcccgaatctcatcctgtagctgactccagttggaaaggaagctgggcaacacagctattttgttgttgttgttgttgttgttgttgagtccattgtcatcctgagcagaattggagtcctgacagtaagagaagaaagggagaatagttattaggtagacagtaggcggtgtttatttcaaaaagttaagtactctgcctaaggtcacagaggtagtgaagatcagcagctgcgtaaacctcctctattgaggaacggatgtccagctgtcaagtgcagcttctctctacatgtctgtatgaataaagcatgaaaatgcatgcactgggtatggaaagccctggagtttttgatcagccacaaacagcctaggaaatatttcttgcaggatataatatgcaatctgttaaatatttatatcactgctctctcagcatttacagtgggacttgcctttcctttttgtccatgtaaccaatagggtaattaatctcagacctgactcactaatactttgcccttcaagccatcaaactattggtgcttcacttctcccattttgaaaaattaaaaagtgatgtgattactatttgccttacttagggttcattcaggaaaccagacactcttctaagtatatcaaccagcaagacatttaatacagggaattggaggcttaggtaacctttcagagggctggggagtgaagggcagagtctgtcaatgatctctgctgcttgtacaccaaagaggtctttctcaggagaatgcctggaagttgctggaaaagggctgtatctgctgtctgcagatgcccacatatctgtataaggctaccaacagcaaatgaatggcatctcctcttctacctttggaattgcctatgagtgcttctcattggcagtctaacctggagccatgggatattgcaagatgtatttctgaagcttctcagggaaaaatgtagaatggggtggggtaggatgaggaggaattgacaacgaagtctgtggcagaaaaaaacatttgaatctgaatagaggaatacatatatagcatattttaggaagaagaacactctcttcagatgttggcaatgttgctactagtattattaccttattctaggtatgtatctttgggaggtaaatagggattctttgtatgtgttctgattatcttcaagtcatgatgatgctcaataaataataaaaaaggattcaataacctgcatagatggtgcagaaggtaatatattctgtgaggctctgtagtgcagtgggggtcccagagatgaggtttaaaaaacaatgcataattcaccagcatgctctggaaagaccagtcttcagaaaacaattgtggatgactcagcttgtccgttcgttcgttcttttcttttcttcttttcttttctctctctctctttttctcactttctctccaaaactatctggaattctttacttgctatagttatgcatatgacttatagcgagctgataaaatatagtgcaaaattaaatacaatgccggaaataatagaataatctcagaatgaggtaacctatagatgtatgacatagtttggtgttgggggtagagttgtaacctctagttatctgctatctgggtcacatcaagcttttagtgtgtgtaactcacagagttttgaaggtgtaatttgatctgtgctatacttgagtctgtgaaacagcaaaacccattatgactatgtcctacagcccttgtaaaatcctaagtcttgagcttcaggattctgctgatatttaatatctgaattatttcaaggaaggtaaggaaagtgtactatcttactatgtttatttcttgagtgaggaaaattgaaagggactaaaggaaagaactcgttgccaagagcagtgtccagaggtcactggttttgctttgtggctttgctggaataaaaccaacgtgtttggggttgcctaggtcttatgttgggtcatctggaggcagatctggagatgagaattcctgtgtaagtgattcattaaacaaatactcccaagagaaatcagtaagggaatgggagaagcaagacagggagggatgagagtccaatttcaggagacatctcagaactagtctgatcctgcagggaactttggaagtacaaattatacctcagagtttgtcctgaattgaggcaagggggctgggctttcatattgccgcttagggctgcttgggtggaggcagaggcggaggcggaggtgcaggtgcaggaaaagtgggtagaaggcaaataaacccccaggaactagctatttttgattgcaggcaaggagctctagtagttcctagggcaggccttcagaaagtctcaggtgttggccattagaaaagaaaaaacatagatgctggagggatgtacagaagttataaaagggatcccagggaatctggtcagagccctgacagtgtacttgtaagcttctcttttgcttttatgaaacccagaatctggagaagggagagagaaattttcacatggaactgtaaagtttctctaaagcaagggttgacgaactttttctagaaagggccagataaaatatttgaggctttgtgggccacagggtgtctgacccaattattcaactctacaactgtactgcagaagcagccatagttgacaggtaaacaaatgagtgtggctatgttccaataaaactttatttataaaaacaggggtagggtggctggatttggcccagggaccatattttgccaatcgctgctcttgaggttctttatatgtgcctaagtttgtttttcctttatttattccctatctgttataaaacacagaggataattagtacctttgtctatctaaatgatggttatgacattatgatgtatcttaaattattctagatcactgcctccaatctttctggcatcctggccatctttcacaatgttgcaaagataatcttcctgaagcatgactcatctccttttattcccatgctaaacatatttagctctctcttagctgtaaaataaaatataggcttgttaacatggcattcaggaatccctgtgatctgaccccaggccaattttcctgcattattttctgttctccatcctcatgtacttatagtccagctacattaaattactcgccctctctccaatatgccatatcgtgtgtgtttgctatctccttgtagtttttttcatttttatgtatttaaactgactatatactgtcaaaattttatatatatatatatgatgtacaacatgatgttttgatacatgtatacattagaaaatgggtaaattaacatatccatcacctcatatatttatcatttttgtggtaagaacatttaaaatctactcccttagccattttctagtgtacaatacattgatattaactatagtcactatgttgtacaatacatctcctaaacttattcctcttatctaactgaaattttgtatcttttgaccaactccctaaccccattcccccacccctggtaaccaccatcctactgtactctgttatgagtttgactgctttaaatttcgcatgaatgagatcatgcagtatttgccttttggtgcctggcttatttcacttagcatgaagtcctacagattcatccacgttgtcacaaatgacaggattttcttcttttttaaagctgaatagtattccattgtgtatatatactacattttatattccattgtgtacatatactacatttttaatccattcctctgttaatagacatttaggttaattccatatcttggctattttgaatagtgcttcaatgaacatggaggcactctctttagcgtactgatttcatttcctttggatatatccccagaagtaggattactgctttgtatggtagttacatttttaatttttagaggaacctccatagtgtttttcatagtgactgtaccaaattatattgccaccaacagtgctcaagagttcccttttctccacacccttaccaacacttgttatctcttgtcttgttgatagtcgccattctaactggtgataggtaatatctcattgtgtttttaatttttatttccctgatgagtaatgatgtggatcattaaaaaaatctgttgacaatttgcatgtcttcttttgagaaatgtattttcacgttattttccctttttaattttttaatttctttttttttttttttttggagacagggtcttgttctgtcacccaggctggagtgcagtagtgtgatcatagttcactgcagcctctacctcccaggctcaagtgatcctcctgcctcaacctcccaagtaattggaactataggcaggtgccaccatgcccggctttttttaaaatttatttttgtagagacagggtcccgctgtgttgcccaggctggtcttgaattcctggcctcaagcaatcctcctgcctcagcctcccaaagctctgggattacaggcatgaacaactgtgcccgacctcctttccccattttttaaccaggtgatttgctttcttgatattgagttgagttttaaatatattttggatattaaccctttatcagatgtatggtttgcacatatttttgcctctgtctttgcccctgtttcttctcctggaatgttcttctagctctacattttgaaatcctaaccattctcttaagactcgattcagtcaccttctccattaagcattttctccatgcagaaacagtctctcctctggactttgataacaatattgtctatttctattaaattttttattttgtttacattgtactagacagttatttgctacattcactgcatttttagtatactgaggtctctcaatatatatctatatatttttgcccttcacagtggcttgcatatagtagatattcagtaaatggagttttcagatgaagggcgcatttctacatcttgtgattattaatgatttaagtgctgaaactctgacattatttttctttttcctttttgtaggcgagagctgttttggcaaaagttggctatccagagtttataatgaatgatactcatgttaatgaagacctcaaagctgtaagtgctaaatttactgtacttttttttttctggcaagttttactggccttgtgcctttcaactaacccaagtcctagcaattaaaactggtgatgccagaaaacaccaacttttgattaattccttggctagatatgagcctgaatatgccaggcagatcacaagatttagggcagattcaaaataaagaagtgtcagaaacgatgcgtagctgagtgggtaccaaaaaacaaatggacttgggtttggcctaatttgatcataaaagaaagaattaagcaaattgagtatgttacaattagtgggcatgttctaatggcaaatgcatcatgtttgttgttaaatactttttatttgcttcattcgtattaaatgaatagtaataaatctgcctgctgggagttaacttcattaaactttatgagtgttttggcaaattaaatgcatatacatacgactctataatttattgtgaattggattgtgtatttgcagtaagttactgatgaaaaatggtcataattcttttttatttcaatatttttggacatgtattttccagtaggtgtattaattacaggcctttctattcacaagcactgttatttcctctcctacaaatagttctgataagtgatttttcttcctcatttaaaaaaacctgtttttactattcactagattttcttgaaaatgtagtcttttgaaattctttaagtaactatagttctgaggtatagctctttcctgaaattgtggttcaacaagtggcatatctgaaaacgatcccagctttgtagatgagcatcaaaattttacaagactattcaaaagtgagagaaagcattaattagaatcttcctccattgggctctaagatatagcctcccaaaatattgatacagttgctctggaagaaaataatgatgcctcatagcatcctaaaactcagtctatcttattatacactgttttgatgatgctgaaaatcccattattattatcgtaactaaaaatattgaagcacttgacatattcatgtacattatcttttaattccttcagtgattctgtgaaatagatgatgttcattcccattttgcagaaaaggacatagagactcaataatttaagtgagctcctcagttccacacagactttcagagccaggactgatatctgggctcaggaagctctgcctgtaatcagacaagggattcttgagggtcctttttaggcagctatgctggaggaacagaggcatcagggtggagacttggtgggggcagtgtgaccagggctgttggaagaagagcagagggaaggccatgttatcaaatggttaagagcacaggctccagtatcatgggcctgggtttgaattctgcttcttgtacttactagttatttcatcctgtgtaggttacttaacttcggttagcctccctttggttatctggctactggaaatataataaccaagtcttagtattgttgggaagattagatgagactgtataaatgtaaaagcacttggcataatactctggctcagagtatagcctacttcctataaagggtagctttgcggatcaatatggaccatttgtggtccattttcaaatcagccatataaaatattccatttcattgatccttaatagaaatagactcaagcgtgaatttctaccaattttggaaatatatctgtatcagccaggaaagcaaaaagcacagtaggtattttaaacagggaatttaatacaggaaatgggttggaaggcaagaaaagggaaaatagataaaccacaggttaaactgctgttgctactaagaagagtatcatcagggcacaaagtaccttagcaggagaacctgggtaactccatactattggtatatattctgagtcagcatgtggatgagaaggtttgagagacagtttgatgtagaggttataaatagggaccgtggagtcaaagtgcctggagtaaaacccccagtctaccatgtaccaccttgttacctagggtaggttatgtatcctctctgtgcctttcttcatctgaagaatgaaggtcataccaatccctcccatataggatttctgggaggatcaaataagttaacatatttgaagtgtttagaatgaaccctaacatacaatcagcacaatacatgtgttagctatgacatcctcaattcacacttgtggtagtgaactattttggtttgaaaaagtcctcatgaattaactcatgcactgtccaggtccctcaaattgatttaaaagggtatacagatggagcagtctcaagctttaatcgaataaggtagaacttaaggcttactcacaatatttagttgatcaagttttgttggcattctgttgctaagttcagagccccaaatttaaggacccattgaatgcaatatcttttgtgaaaagaaaccagatgccaaacaggatgccatgttggctgtgcttctttgtttctctggggcctgaactgaagacattacacaccaagatttttaatcacttctttgaagaaatggctttcatctgactcattgccaaagcagacacaattacgcccaagagttttaacagtttaaaaacctgacagtgaaaaaaattccaggtacatgaagtaaaaagacatttgtattcagaaaccgattgttttagtcaatttacacggtgctataaagaaatacccgagactggataatttatagaggaaagaggtttaattgactcacagttccacacggctggggaggcctcaggaaacctacaatcatggcggaaagtgaaggggaaacaggcaccttcttcacaaggcggcaggagggaagagtgagagttcaggaaaaaactgccacttttaaaaccatcagatctcatgagaactcactatcacaagaacagcatgggggaaactgcccccatgattcaatcacctccctcccttgacatatggggattacaagtccctcccttgacacgtggggattacaattcgagatgagatttgtgctctctcactttctctccccctcaagccccgcccttttctttttctgacagtgacttcagtccctcctccaaacctcagctctggagtggcaggcagttctcctctactctcctaagtgatggtaccatcacctcctcccttctgtgaccctagacacaggagtcgcagctgtgtactcctgtgactctcacagagccaaatcatatcactgatagagaaaatgaataaaacccaccctaaaaataggtaaaggatgatatgatagattgtaatattgtcactgagggcaatagcaaaaagactgaagtattcctggtacacaatgagactgttttcagttttaagaaacatgtagataaggactgctataggacctatgagaaatttctggtaatacgagctctgagcatgagaggctgttacaaatgaaaaacagcatgctgcatttgagacaggtggagatatgattcatcaggcacaaatgcaaaaggaaagaggagcgagattacctgatggatcagacgaaggtcaaggagaaatgttgaaaattgaagttgggctcatgtggaaataaaagcaaatgagatagaattaagaggtaaatatgcaaaggaatcagaaattttttaaggatgacaaggtaaactgaggtactcagcaaagcatttccgaacaacaatcttgtagtttttgaaaagaacaggaagaaataaaatgccctttatttgaacccccatcaacatgcaggaaagcctgttagcctaaaaaggtaggcatgagcccattttcaaatcagcctaataaagtattccatttcattgattcttaatagaaatagattcaaaagtgagtctctcccaattttggaaatatttcagtattagccaggaaagcaaaaagcacactaggtattttaaacaaggaatttaatacatgaaatatgttggaaggcaagaagagggaaaaatgagataaaccacagattagtaactttagaaagcagctgcgactcctgtgtctagggtcacagaagggaggaggtgatggtaccgtcacttaggagagtagaggagaactgccactccagagctgagctttgcaggaggaactaaagattcttccagagttattgtcagaaaaagaaaagggagggagtagagggggagagagagtgagagacagcaacacagcacccttttcccttctgcaacccactaatttcctgtagtgcctcctatttgcaggaagctaattggcaaaggagcttgagaaacagttttcagattcccagtccccagcattacggaacagagtgaaagggtaggcatgtagctgaaaaactacaggtaaataactggcactattaaggacgttactaaggaccaaagtcagaatcatggctggcctccatttacttaggagaattggaaatgagaaaattttcagaggccaaagtttctggtgagtgatacacacatatatagacataaatgtgcatatagggatatgcagatatgtgaacctatgtaagattctctgtggtgggtctggtctactttggccagtgaaacactagtgtgtgtgtgtagtgtgtgtgtgtgtgtgtgtgtacatgacagagagtgccactctgcaagagtgaggtgatattcagatggaatgctagaatgctgcagaaaaagaggttgttaaaatattaaaataattctttactatttgttaaaaaacacaaaacattgcgctcagctctttcaagggacccctggccatcatggcactggagagctaagggtgggcattggaggtgggacaccctggtgccccccaaccttccagccaggcctctgtaactctctcacattggccttcatccagactgttccactggtcagagcagaccaagaccagccccagtgtggagatgggacatctggttccagtgctagtgtgctggctggaactccctcagacccaccttcacatagctgtttgtaggaattgcatcctccatggtacactgtatatgtggattattaaacattttgagcatcacctcagtatatattaggttggtgcaaaagtaattgtggtttttgccattactattaatgccaaaaactgcaattacttttgcaccaacataataagtatgtctacatgtatagacacacattacttttgggcaaagccatctaaacacaccaatcttgcatgttgctttgttgtttgaataaggggacatgtagatataaaatacggattccattaagtattcagaaaatcctttgggtgcctaacataaagtctttctaatagatatttggatatatctctgagtatctttaaatggatttaaattaaatgaaaggtatcctagaatttacacttcctactggcacagtaaggaaagtaccacaattagtgcttcagtatttttcatctgcctattcctacatgtaggccgaagactatactacagatcatttgcattcctatgtactgccttataaacatgtacttatcctacagagaagctgaacacatttccttgttctgcgcttattacaggttctccatctttggggtggtggtggtggtaataactttattcttccatttagtctgtggatctgggataggatattcaagaagagaaatgtaggctctcctgaattttatgatcgggacagctgttcctgggaaatgacacaagaatcccaattaattccccaaaggtcacgcaattgaaaagtcaagagatggaattgattgaaagtgatcatcaacttgacctagactttttccagtaactgaaaggacaagaggcttttgagccaagtattgtctcttgccaaatttaattttttcattttggagattacaagcggctttaaaatattcatgcgaattcattcttgtttctacttctagaaaaaatagaactttctcaatagttgctgggtttcaattctttttctcatccaagggccttttgaaatatttaaaattatcaaaatattattacaattagcaagtcttctaaaagtaaaaactgatcccactgatattattttttaaaagttaatatttttgaaggaaattcttctgagaaaatttcccagaaagtgttctgagcccaagaacatatctgaattttctatcagttataatcatattctgaaggttttggcagaaaatttgggaactagagaaaacgcactcataatattgctacataatatatacttctgttacagtttattaatttgtttttctctatttctgtactgccgtaattgatgtttacatataatttggtacaccaacctttacagtaacatattgttttgctactgtctttatagcctttgttaccatgattttaactgctgtatagtatttcaagtaagttgtatcatgattgatttaatcactgcttctactcccttcctcaatctcactttgtccttgaatcactggttctcttattaagaccaacgaaaataacattggagtcagagccaaatgacttggacggtgtagctttgccaaattccgtaatctccttagccctgtttcccatctatcatatgtgaataacagtgactggcccctgcctacccccaaacacttaacctgtctcaaggaaaaacgtaagacctgtcctctattacttgtgatttccattaaataaatggaatagatcaattaaaccaggctaagaaagaagaaatattctcaacttaataatgaaaacaatttttaaattatctttctaaacataaataagctatggcaaattgtaattaattacctctgagttttgtttcccccaattattttcagggttctggtaggtccttacttatctaatgtatttttagacttgggacccttttcttctttacaacgttttttttttttttaatttttaggcagagtctccctctgttgcccaggctggagtgcagtggcacaatctcggctcactgcaacctccacctcccaagttcaagtgattctcctgcctcagcctcccgagtagctgggattacaggcatgtgccaccacacctggttaattttcatatttttagaagagacgggatttcaccatgttggccaggctggcctcgaactcctgacctcaagttatctgccagcctcggcctcccaaagtgttgggattacaggcatgagtcactgtgcccagccctttagaaagttttgagatggctttctgtttaatgtctgtagaccaacctgaatatcaagggatttttttttttcagatggaacagtaatgaaagtatcacaattagcaagttttctaaaagtaaaaactgaccccactgatattatttttaaaaagttaatatttttgaaggaaattcctctgagagaatttcccagaatgtgttctgaacccaagaacatacctgaattttctatcagttataatcatattctgaaggttttggcagagctgtcttggaaacaaaagctgaaaaaggcaaagggttgaacagtggacacatcttttaaccatatgatctgggaatgccttaggattgctagtaaggttgctttctataacaaggtgcttactctgtttcttctgaggctaaaagaaaacctttatcttaaaatataatcaattataagattttggccagcgcggtggcccacacctgtaatcccagcactttgggaggccaaggtgggcggatcacttgagtccaggaattcaaggccagcctggccaacatggcaagaccgcatctctactaaaaatataaaaattagctgggcatggtggtgcatgtctgtaatcccagctactcgggaggctgaggcacaagaatcgcatgaacctgggaggtagaggttgcagtgagctgagattgcactgctgcactctagcctgggtgacagagcgagactgtctcaaaaaaaaaaaaaaaaaaatatatatatatatatatatatatgtatgtatatatgatttctttttattatgaagcatttcaaatgttggaacatgagtaaaataatttgaacacatctattttaacacatagtaaacatattgccatattagctttgtacatgcacacacacattttaaatgaacagatgcatttgaaattttgtctgtaatcttccttgatctaatctccttcctctgcgtctatctccatctctgcatataaacactaccttgagttcagtcttattattgttattcccatgcctttctttatgcttttgctacataggtacgcatccatcaacagcatacagtgttgttttgcatgtttaaaaactttaaatttcctcatagatacaacttaccttattcactctgcataatttttaagattatttcatgttcatgcatacagaacaatcatgtaaactgttgtattgccttccattatgtgaatataccacaatttgtttatcagcccctcttccctgagcaagcagtttgagggacaatttaaagtcatagtgttataatttgttggccaagcagaacacagagggtgccaggaatcaatacttttatttctgcctttctccatgtgccttcagttattttactccttcctttatattttggcttggtctcctggaaagattgttaagatgactccttaacaaaaacttctccacggacatgagaacccactctgtgttagggaggagctaaatgtgagccagacattggtcaacaagtaggtgactgtcgagcctattaccatcaaattgcatatatacattcgtatctataatgtaatgccttgtgggtttcatatacacgagtattttactttttgcttttaaaagactattaaagttataaaaattacagtttataagaatttggttacccttggttatctccttattcaaatgtgtatttttcttaatttccatagtaatatatttaaaaacccaagcattggaggtcactacaaacgattgcatgaacagctccacagatcttatttacaataaatagctaggttaggtattgctagttttgtagatggagtgcctatagaatggaaaccgtctgccattctccttccaaaacaaggaaaggaactaaaaaagcaattatgtctgtttccttgtcttaatagacaacattgttgtgagctgctaccagctttctgtgttcccatgcaagctataatctatgatttgcctctgtaatttcattaatatttagtgaccagagactttttgagtgttaacagatacattctgttaataattattctggtgacttcattgtgcttatggtggaaaataggtctctgaatcacatttattgttttcctttacgaacaactaccaattatttgactaaatcattgtctataagctaaatgagttttcagccaactaaactgcatgttactgaaaaaacttacgtgacaaattaacaaagtacacattttaaaaaagatcaaggactcgtgagccaagaaatttcaaaccaaagataatatggtttataaaggttgaagtagatttttcaattagaaagtaaatggaacgcattgtaaatgactgcagcttctcttgttgtgtttttactgtgatccagaaatgactatattgatttttgaagtttttacgttaacaaaatcactgagactaaatttcatggctttgtgacttctgggtcaactgataacagctgagagaggctgtgactgatgcagcttctctgctagttgctccttcctatgctgaagtatttttttagagccatcttttatctttacttagaacaatgatgttgtggtttgttttattcagatcaagttttcagaagccgactactttggcaacgtcctacaaactcgcaagtatttagcacagtctgatttcttctggctaagaaaagccgttccaaaaacagagtgagtattaaacaaaaaaagttaaatagataaatacattggtgagaagcggagtctctttagattaaactttgtaattcccctcaagtcagagtagctggcttgccagttaacttgttttagcaaaatctgtgtcatgttttgccaactcttattttttatattacgtgattcagatcttaagtctaattacaggtcccccatttctagcatcaacacatatcaagagaaggcttattagaatgcaaacattaaagttatgtctagatctagttatgaatatatagagagggaataatttctctggatttttacattcatgtaataacttttgaagaccttaaaaaagaataaatacttaaactatgattagaaatgtcaaagtaaatgtatagaagcaactagaaaatatttgttgaggtaatgcctatcaaagaactgatagctatattgtttttatctaatagcagttatgatttatttgccttcctctcagctgcctataggagtttttcctacagataggagagtttccttaggaacttttaggcccagagcccaccagctacgatttcatcccttagcaaaatgtcagtgatgaatgtagcagctaacaattattatttgtttacattgtaccagaaagtgctttacaatttttaattcattttatcctcatacgaattctgtgtggtataggtactgttatccccattttacaggaaaataaaaggcttacaactgagaaattcttcagcttaggtttggatcacattttgttctgtctgctggtgcttttgattcctgggactggattctgttctgctaaggcccacttctccaatgcttttttttctctctgttctccagattggataatttctattggtctggatttcaactccagaatttctttttttaatttaattgtattattatttttttaacttattttttatttcaatagattttgggggaacagatggtggttggttacatgaataagttctttagtggtgatttctgagatttcagtgcacccatcacacgagcagtgtacatgtatactgtatcagtgtgtagtcttttattcctcacccccctcccactctttccccctaagtctctaaagtccactgtatcattcttatgcctttgtgtcctcatagcttagctccctcttatgagtaagaacatacaatgtgtggttttccattcctaagttacataggataatggtctccaattccatccaggttgctgtgaatgccattatttcattcctttttatggctgacaacttcggaatttccgtttgttttttgtagtttctatttctctgttgtgattctttgttaagtcattgtcatcatattttctattaattcttcaaataaagtttattttaattctttgaagtcatctataatagtcactttcaagtctttgctaaatctaatatgtgggctcaaactaactagagttagtttctattgattgcctttttattaaattaattaatttttttttacagtttttcctttgcttaacattttttgttgttgttgctaatgacagtttagatagcatgttgtagcaactctggattctgatttatttttctgaggctttttttttttaaaatcaaaagtaactgtcctaacttatactgccgaatagatcttctctgtggtatgtagctgtcgatgtctccactcagttttttaactcttatttgtagttattagcctcacttcctgctggttgtccctgtgtctacatagcttagtgctcaatcagtgattaggtcagagcttgtgcttaaacaccttgagtccatagggcttctaccctctgccagttgctctgtgtgtgggttgggagcaccttcaaagttatagccagttctcagtccaccttcaatttcaccttccaccaggccctcactggtcttccctgcacatgtgcctagtttcccagtcagccagggatgtgtggagtgcttatttggcccttctattactatttcagttataggatctctcttttaaatttctgactgggttttcctcgttagttttctactaagttggccattcaaaaattaaaaaaaaaatgttgtgggtatgtagtaggtgtacgtatttatgaggtacatgagatatttcaatacaggcataaaatgtgtaataatcacatcagagtaaatggggtatccatagcctcaagcatttatcctttctttatgttacagacaatccaattatacagttttagttatttttaaatctataaaaagttgttgactgcagtcaccctgttatgctatcaaatagatcttattcattctatctaagtatatttttgtacccattaaccatcccctcgacccagtacccttctcagcctcattctactctctatctccatgggttcaattgttttcatttttagctcccacaaataagtgagaacatgtgaagttttctttctggggctggcttatttcacttagtattgtctagtttcatccatgtagttgtaaatgacaggatttcattcttttttatggcttaattgtactccattgtatatatataccacattttctttatccatttgtctgttgatgaacacataggttgcttccaaatcttggctattgtgaacagttctacaataaacacgggagtgcagatgttccttcgatgtactgattttctttcttttaggtatatacccagcagtgggattggtggactgtaaggtagctctatttttagttgttcgaggatcctccaaactgttctccatagtggttgtactaatttacattcccagtaacaaagtacaagggttctcttttctcaacaacctcaccagaatttgtttttgcctgtcttttgaataaaagccattttaactggggtaagatgatatctcattgtaatttttgatttgcatttctctgataatcattcatgttgtgcaccttttcatatacctgtttgccttttgtatgccttcatttgagaaatgtctattcagatctttgtgtctatgtgtctgtttttatgccaatatcatgccattttggttactatagctctgtagtataatttgaagttaagtaatgtgattcttccagttttgttgtttttgctcaggataacattggctattctggatcttttgtggttccatataaattttaggaatttttttctatttctttgaagaatgtcattgatattttgatggggattacagtgaatctgtagattgcttttggtagtatgggcgttttcacagtattgattcttctaatccattaacatggagtatctacttttttgtgtcctcttcaatttctcgcatcaatgtttttatagttttcattgtggagacctttcacttctttagttaagtttattcctaggtattttattttattcgtagctattgtaaatgagattatcttcttgacttcttttacagatcgctttctcttagaatatagaaatgctactgatatttgtatgttgattttgtatcctgtaactttactcagtttatcattttaatagtttttttggtagaacctttaggtttttccaaatataagatcatattgtctacaaacaagggtaatttgacttctttctttctaatttggatgccccttatttccttctgttgtctgattgctctagctaggacttctagtactatgttgaataatagtggtaaaagtggacatccttgtcttgtctagatcttagaggaaaggctttcagtttttccccattcagtgtgatactaactgtggctctgtcatatatgactattactgtgtttaggtatattccttctatatccggtttttcgagagtttttatcctgaaacgatgttgaattttattaaatgcttctttagcatcagtttacatgatcatatgccccgtgtttctttccactgtgataggacagcactgagttccagtgcaaagtcccacaatcaccgtactctccttcccccaagcgcagaggtttttctctctgtgcccatgtggctgctgctggggaatgagggaaggacggtataggcaattcaagactggctttcctaccctcttcagtgcctctttccttgatgtgatgttaaaaccaggtattgtgattgttcacctggattttggttcttatgaagatgctttgtgtgtgtgtgtgtgtgtgtgtgtgtgtggctagttgttcaatttggtgttcctgcagggaggacacttgctggaggtttctacagccttcttgctctgcttcatcctctatgttggccatttttatctgacaaagctgtggcttttcactgccacccccagttgagtctacccactggggcagcaaagctgctgatttcccagccagcctttttctgacaaaactaaggtctcactgagctaggagggacaggagtagtctcaggcaaaaaggccatagtgcctgctctacttaatgccaagttctagcagtttttaaatattaaattttgtttaatttattgctcccccttgatgaattcccagattcctaaaatggttatttgttgacaatgttgtccagttttgtacttggtttttgtagaaatgatttgtcaaccttctcatgccattatacctgcaagcctggcttccatggattacaattttttttttcatggcccactttttaaccttggctaatattctgatttctagatctttgactggctgtttttatgctgcctagtcttttgctactctccctttcaagtccctgttctgtcctggcttctagaaactctgagcccctgtgctttcccttggcttaagtggtgattaccacttctccctcttatgtttccatccggccatccctgctctctgcccttcaaaccttcctataatatgcacctgaaaaattcattggaggttactgactttaagaggtaggcctaaagctgaatctctcccctacctaaccctgactccagtcaaaagcacaaaggaaaacagctttagaactgctttgaaaaatgatagataatggtttaaagccatttgctccactgtctttggttctttcctctcatcacgttatttctcagtccacctatcctgtttcattcccagtctaaattattcaatagttttagatttaggcttcttaaatccaatactcaaatctgatgactttggcaaatgatttccagtatccctatgaccatctacatgtaatacggtagtcacagatctatataatcttgcccttcaatatttgcttcagatcagttccaactcttttttaaaaaaaaaaatctgtggaaaattgaagggtttcaccaattttttggtgaattttcagggtcttctcaggggctcctgcatattggcaatacagtcagtctaattgtttgatttcaaaatgtcattattcatttagttgtgtagaaaggcctggattagtaattgaaaaactcctaaatgtgttatctttaacatcgtcctaggatactgatgaactttcagattctaatggtcttaactatttctaatattttattcatgccttagaaatatactggctttgcaggcttaggcaaactgagatttgtgtggttttcttttctgtcattgaaaaacaaatagctctttcacaagggtattaaattggttaacttttgggaaaagttctccagaaatggaaatcagtgcaatgcttgtaattcttgtttcctcagactatatgtctatttcagggaaataacatttagaaatttaaggtcttctttgcatagtaaagggatatgagtaaattccttttccttcttgttttttttttttaaaggaaacatctggctggaccttttcaggcattgtagagacttttagcctcatgatactcattggcttgaatggacatctttcaggtctgaaaattcatgagttaatcgagtggggatcattctggagtagctctactacactagtttactttgaacagcatcatgattatattttcacaaagccctgaaataacgttttgcttctttgtgggtgtaggagataaagaccctttatcttttattctcatggaatccattttagctgcactaatgtgcattaagaagtttctaaggcgatgggaaatgtcagcaagaatgaaattaattgggtggtcatccctgaaggtacatatttaggggttggttcacagaattgtcacttcatcagcttgcttaaaaatagaggatttacttactgctcggcttgagttgaaagtaatttctttccctcaggatcaccttctttgacagaaattattttagcccgcctcacttttaactcactctcattctactgagaccaaacacgtctgaattctctatcttttgaaaaatatgtaaaaatgcattaaatgtctttataaattatgttcctgcccagaacttttgtttgcaaaagcattatctatagcatggaatgtgagtgatataatctgcaggatattaataagaaagcaataaatacactattgcttttccattccatattccctagactatctgtaggagttgataagaaaaatgtaaaactttagcctgatgtatatctattttatatggtccaaagaaataggtgtaccaatgtctttttcttcagattcttgtattttggtattatattccttttatgtatctcattctccagtataatttcatccccattattgtgggatttgaaatttctatgagacctctccttaccttatccaccaaatcctttctcaaacacagactgcagaagcaccctaaagacatagtaagaagaatttaaagcacttgaatgatattctctgtttattgaagtggatgtatacatgcaataaattcattttaatggatttagtgatcttctgttcagcacttaccatttggacaacagtcaaagcccataagcaacttaaaatcttgttgggacataagctgtgcaaactcagatgccttcaggggccagtcagttaacaaatggttgacctacatgggtgtaaacaacagggagtggtagggactgtagaaaactagtaattacacacaccacttgaaggaattccaattcaatagtttgttaagccattgtgttgggcaagcaaaacagttttctgggaagattcagcccattgggttggacttagtctgtggatagccaacttttcagcattccatttatctattgctgtgtgataaacctcccccaaatttagagtactgaaacaacagtcattatttttctctctcatggttctgggggtcactaggctcagctgcatggttctcgtttgtggtttttttttttttttttggacacagagtctcactctgtcaccaggctggagtacattggcgtgatctcggctcactgcaacctccgtctcccaggttcaagcgattctcctgcctcagcctcctgagtagctgagattacaggtgcccgccaccacgctgagctaatttttgtagttttagtacagacagcatttcaccatgttggccaggctggtttcgaactcctgacttcaggtgatctgcccacctcagcctcccaaagtgctgggattacaggcatgagccactgcacctgaccatttgtggtctttcatgtagttacagtcagatagtggctggggctagagtcatatggaaggctacctctctcacatgtctaatggttgatgctgactgttgactagaacatctacatatggcctcttcatgtatgttgggtttccttacagcatgttgattgatatagaaagttcaaagagcagcttttctgagaaagaagaagggagggagggtgtgtttgtatgcatcagggggaagttgtatcacctttaattacctagccttggaagtcacactgtcatttctgctgcgtattattctttagaagtgagtcactaaggctaacccataatcaaggggagaggaatttagattccatctcttaatgggaggagtgtaaaaaagttcacaaacacatattaaaactagcacatgtagccttacattagagaatagtaaaactaaatatataataaacttggatgtaatacgggagatatacaaaatgtttaacagctggtttggcatgggccctgaacaaatagaagaaataacagcatcaacaactggtaggatctactggtgcagctgcttaatatcagctctgggtattatcaagtctccatacgtgccctagagtcaataagagccctgggaggtcaggaatggtaagatcatgtgtctgaaataagatgttttcgttattcttgttgaagcttcagaagccccattaaggtctagtttcagagactggttgtttggtttgctttgtctacctttgtctaccagcagttaggaacattttccctgcatggcccttacctgaatattttaaaagtttgttattttaaagagaggggagttgggaagaacaaaaagagaagggacaagctctaggaatacacgttatcttttgtatgtattatgattcattccagtgttatttagaagccaaggcacccacctggattttcccctcttgacctacaaatgttgggttctttggatagtgcattagtttcctattgctactgtaacaaactcctacaacctaagcagcttaaaacagcacagatttattatctcacagttctctagctcagaagtctagggtagcttggttgttttctctgctttggatttcataaggctgaaatcagagtgtcagccggctgggctcttatggggaggttctgggaataatccccttccaaggggattcaagttgttggcagaatccagttctttctgattgtaggggtaaggtctttacttccttgctggctatcgcctggaagccactctttgttctcagagggatttatgcagtccttgcccattgcccctacatcttagagccagcagcgtgtcaaatccttcttacccttcctcctctccgacttcctcctctgttgcatctctctgattccagccaaacaaggttgtctgcttttaagggcttgtgattagattgagcctacctgaataatccaggataatctctctattttaaggtccttaagcttaattacacctgcaaagtccttcttactatgtaatgtaacatgttcataggatccagggattaggacttggccataattttacctactacaggtagccaagttaggtcaatagaggtgctttccccttcacttgtttcctcaggaaagtaggccaaccagcaagtttatgttaaacactagggcttaattgaaataccctaaatttgaaggaaaagaatatgcattttatggaaatatgtctaggtttcggttttgaagagagaagaggtgctctttcttgatttccagtaatgtctacagtataatataatgcttaggcgaactggtttgaagtcagacagaccaggcctcgtacaagcacataatgctcataaatctcattatcctcgtctgtgaaatgggctaataattcctatgttgccatggggaaaaactgatgaatagaaggtgcttaggacatagtaagtgctcaatgaatgttagctaaatataatgataatgataacagaatgacatattcatagacttctttgtagctggggagaaggtatgagtttaccaactagtatcaataattgggtttcctattagtttcatattaacctgatataaattaatttgttagtctgacataattatcctattagacgtaaatgagtaatacaattattctagaaagggatttatacaagttttttttttctttttaatttttttagagactggaacttctgggctcaggcagtcctcctgcctcagcctcccaagtagctggaactatatttgcatgccactgctgggcctaggagtttatttttagcaattttgcttaagatgaattgcttggttttaatcataacaagcagtcactgaaactcacaaccatctaagtcagggtttggccactatggcctgtgggccaaatctcacctgctgcctgtttttgtgtggcccatgagctaagaataatttttagagataaatgtttgcaggtggtttgatgatggggaagccctaactttgttctgttttttgtttttgttttttaattaaaataacttttgttggtacgtagtagttgtaaatatttatggggtacatgagatattttgatacaggcctgcaatgcataatcatcacatcatggaaaatgggagtatccatcccctcaagcatttatcctttgtgttacaaacaatccgcttatattattatagttatcttaaaatgtacaattactattgactatagtcaccctgttgtgctatcaaatactaggtcttattcattctttctaactatacattttttgtacccattacccatccccacttctcccccattcccctaccgcccttcccaacctctggtaaccatccttctactctctatctccacgagttcaatcgttttggtttttagatcccacaaatacgtgagatctcacaaatacgtgagaacatgcaatgtttgtctttctgtgcctggcttatttcacttaacataatgacctccagttccatccatgtgttgcaaatgacaggatatcattctttttatggctgaatagtactccattgtgtatatgtaccacattttctttatccattcacctgttggtggacacttaggctgcttccaaatcttggctattgtgaacagtgctgcaacaaacatgggagtgcagatatctctttgattattttctttcctttgagtatatacccagcagtggggctgctggatcatatggtagctccatttttagttctttgaggaacctccaaattggagaagcataactttgaaccccaattaagcaaaaggttatctcatcccaaaataattccgttattctcattaataggcatatattagaaataattgtactcagctgggcatggtggctcacgcctgtagtcccagaactttgggaggctgaagtgggtggatcacttgaggtcaggagtttgagaccagcctggccaacatgccgaaaccctgtctctgaaaaaaaaaagagaaataattgtacttgattactattgttattttttggatttcatcaataaaatttgtggacagtttgctcttaagtacctacgtaatatccttgattttgcctctttgcctgtaaagcctaaaatatttatgatctcactctttacagaaaaaaatttgctgactgctgatcccagtaacctattgtgcatttaaggtttgggtgtagactccttttagatagaagggatcctttagatgtcctaatgcaatgccttaattttatagctaaaaccaaaccccaggaaggtaggtgactcttcccacacaattcagctagttagtgatagaggcagtacactttccactggagcaggcagaccctctgggtggcatagttggactttattcatctttctttaaatggacctctgtgttgtcaccaatccagaacttttaaatggacaggccagaggtaatgcagcatagaaacccaattgtccattcaacccattgaatagggcctggcaaatatatagttgctgtgtttccatttgcagggacagccctttagattctagaatttctctttaaaactttttcaaaagcactggtgtgctgactttttttctgttaagttagtaacaataaataactgggcatgttaatatattttcattgagccatgttcagtttaggatgagattgttcattgagcagtacagtagccccaaactgagggaataatttcccctcatgtccaacatccccattgttccatgttatctgctaataaacccagccatgctgtgtttgtctttgcttccctcctgcctgtataatgatgattgctctctggcatttgtttctttttctacaggtggtttacaaatccgacgactgtcaatgccttctacagtgcatccaccaaccagatccgtgagtacgggttccttgtctccttggtaacctggtataaaatgcaaagaacttttccatgactatgatggagggtaagacatttcttatttcccccaaaagtggcagggtatgctggtgaaggaaggttgttctcctacctatatgccaaattttcctcactctcttcaccttaccagttttttttaaagctttatgtcaccactgattgaaaaaaagtcaactacagtaaaccaaattaaaccataatgaagtttgccatgaaaaggagcaagtttccactttcctttcataatggccttactgattttgtccatgccattttattcattcctaggattggtggggaaaacagcaggtaactgagcagattgtagaacctgagcggaccatctgtatgtaagaaagaagcttggaaatattcttattaacgctaggaagttatgtcttgaggttttctacttacatgtatcaggtatatgtaattaaaaataccatgataaatttaaaaaattattatttttattattttttaaagacagagtctccctctgtcacctaggctggagttcagtggtacgatcctggctcactgcaacctctgcctcccaggttcaaattattcttgtgcctcagcctcctgagtagctaggagtacaggtgtgcaccaccacgcccagctaaattttttttatttgtatttttagcagagatggggttttgacatgttgactaggctggtctcaaactcctggcctcaagtgatctgcccaccttggccttccaaagtgctgggattacaggcgtgagccactgcacctggccttaaaaaattattaagatctgaatggcacaaataaaaagtctgacagcttccagccttggcaataaggacacatactcactgctggtggaaagatagatgggctcatccactttgcagggcaatttgacaatatctcaaaaagctgaagttgtgcatgcatacctatgaccatgatgtgtgctcctggaatgtgctctaatgttgtgagtcttgaaatgtggtccttggacctgcagtaatagcatcatgggggatcttgttagaaatgcaaattcccaggccccaccttaggtctattgatcaaactttggatgtggagctcagaaatctggtgcaataaaacctgcaggtgattgtaatgtatgctaaagtttgggaacagctgccctagagaactcttgcacaaggcataaagaagcccatgcaaaaatgctcataacagtattatttataatagtagaaaaagcaaaataacctacatattcctctgcaggaagatgagtcacatgtggcatattcacacaaaggaataccatacagcagtgaaaaatgagcaacatatattaacatggatgaatttcacaagtaaaacaacttgggaaaatatatcaagtatgatactatataaataaagttgaaaatcatgcagaacaattctacacatggtttggaggtccatccatttgtagtgtaagtgtaaagacattcatgagaatgacaaacaccaaattccggttggtggtggcttgtcttggggagggtgggccactgttgctcaaatccttgctggtttctcctcatctcccatatctcttaatgatggcatgccccaaggctcagtctgcaccttttctgttctcttctctccatctttgctcacttgcttggtgataacatctaatctcatggttttaatcacatttctacagtgttgaatgcaggggatggaatttatcacccttgttcataccactactatctcccacctggattatggtaatagcctcctcattggcctccctgcttttgttcttaccccccttcagtctattctaaatataatattgtagcgattttaagacgttttacaatcacatcgtgtcacttctttgctcaaaagcttttatcagcatcccatctcactcagagaaagagccaaattatttataatggccttaaggtctgttatctttctgcctgtacctcctgctactctcccccttcctccctccttctgttccggccacactggcctccttcgtgtttatagagcacacctgacacgctctgctctgggagcatttatacctggggttggctttctcttggaaaacttccccaagtgacctgcctggtttatgctcccatttccttcaaatctttattcaaaggccaggccacctccttagggaggcatcctgccttccctctggccagttggccagtctgccgtgggtcctccatactggccgttgttcctacaggactctggtcagaggacagccggaaggctgtggctgctcactaccagctggcacatcttcttagagccgccctcgtgtggccactgttaggaatggcagtttctgcccgacttcggtctgagagagaaatgaacagaaagacgaaagacaagcagatggcgggatttttttatttatacattaatttacataaccaagtaagttgttaaatattttgaatgtcacttcttactgtataaatattcattatcacgaaactaccattgctttcttaaggccctaaatgccaacttgagaactaagttgcatatgttatatgggaacttatgatatttgagttattaattataactaatacttataataatttattattaattataatcacatttaggacattctattgggaaatagaaattgtttagattattcacttaaaaacgttttattgtctaatatttggtacatgcaaaagaacatgtaacattttggcacatataagttataaagaatatatgaaaacatgacgaaattaatatgtgcctacgacgccctcaccccatcaggaaccatccctccctctcaccacagaagtaacactcttctgatttgagggtttatcatttttgttttgtttttttaaaataaaactttatttatataggtatccctaaagaatatgttgtttatttttacttgtttcttagtataataaaaatggtatcttactgtatgcaatcttaaacaactgcgatttttcagtcaacatgtttttaggatttgttcgtgtagcatgtggtggtaggttgttttcatgttcactgctgtataatatttcatgactgtacccccagattgtttattcttctgttgtccagcctatgagtccccacacccaggtttttgcttatgaacagtgctgctctgcatattcttgtgaatgtctcttggaacaagtgtctgagggtatacatccaggagtggaattattggctgataggaagaagttatctaccagataatatcaaatgttttccaaagctggtgttccaaagtacagaagtgtttctgttgttcctcattttcatcaactcttggcattggtagatttaattttcaccagtctagcgagtgtaagagatcagctctgatgcaagaaaagccgacgtttccgcattcactttaaaatgtcactgaaggcttactgctccttggggtacttaagtgtgtctaataatagttccatctccagggttcacccctgctcagcctttttcttgcctgggaagggctaatcctatcagaggtttactgaggaagaaaccatttcagggtaacccaatggtttcatgaaagctcatgggcagagggttttttttaaaatgaacaatttgaaacagtattttaattaagagattcaagctgtttctgttttcctaatgaccagtgcttgctctcattgtaaattacattcccaggcaagatgacaaggaatcctttgggtgacttttttttcccctctctcctttctgattttctggactacaaattaagacaggtggagtttcttcttacacacttccccaccgggtttcctgggacttcccccaccctacaactgccttctttttgcttcgctgaagaagtgaaaaattgaggtgattctctaaaatgaacatctttattgattaggggctgattctgacagcatgtggccatctgtttaattgggttttacatctaagatgtaactatacttagtaacgtgatttatgacaatttcattcagttcccattatcattttctgatttatgctacttaaatcttcttctgcacgcaatagagacttgaatagaaaacagaaaaacctgtagttgttttttctttttcaaatccatgcctttgtgtggaaccctatgatttgtggccatctttcaatgttagatttttacagggtggttacaacttcttatttttcttcccttgtcaagctgggtagcaacgtctctagacatggcatgtagtgtgaaattataatgatttaaatctgctgtatgaggagttaaactcagtagctgtcataaaatttaattatatttgaataaggtggttaaagaggaaaacacaaatctgaaatgattggtgcttaaccctaactttgtgataactgcgacactgatcttgctgcttttcagagtggcaaggtgagaacatgaatcagagatctagtttgtatggccttagtcgaggtttttatccttccagacccctattgtcctgtctgccacatgttgaggctatctagcccatagggttttaggggaagatttaatgagacgaatttgtaaagtgccagcacattgccaagctcagggcttgtatatctaaacctggcatgccaggaatccctgcgataaccattgtgtcacaagacaaacagcaaaatataaagatcggcaggggggattatttcaaacttttgccctcaagagatcttaggccgggcatggtggctcacgcctgtaatcccagcactttgggaggctgaggcaggcggatcacctgaggttgggagttcgagaccagcctggccgacgtggtgaaacctcatctctaccaaaaatataaaaaattagccaggcttggtggcaggcgcctgtaatcctagctgctcgggaggctgaggcaggagaatcacttgaacccaaaaggcggaggttgcagtgagccgagattgtgccagtgcactacagcctgggcgacagagtgagactctgtctcaaaaaaaaaaaaagagattttattataatgttccacattataatatgtatgcatgcaactgactaaatgctgagtaaaagaagccaggtgtaagactaaatactgttctgtttcatgtgtataaagttcaggaacaggcaaatacatctatatgatagaagttaaaataatgactacctttgttgggggtattgactgagaggaggcatgtgacacattctttatcttgatctcagatgtggttacacaggtgatacaagagtaaaaactcaccgtgttctatcattaaaatttgtgtctggctgggtgtggtggctcacgcttgtaatcccagcactttgggaggccagggtgggaggattgctttaacccaggagttcgagactagcctgggccatatagcaagaccctgtgtctacaaaaaacaacaaaaaattagccaggtgtggtggcatgcacttgtagtcccagctactctggaggctaaggtgggaggattgcttgagcccaggggtttgagacagcagtgagctatgattatgccactgtactccagcctgggtgacagagcaagatcctgtctttaacaacaacaaaaatgtatgcttttactgtatgttaagtgacacctcaaaataaataggaacactgctccttttctccataaaaatgtttggaacagcgtatagtatgcatggacatctggagctaataataggttgcctcaggctaagtctctagatgtgtagaccagggattggcaaactatttctgtaaattgccagatagtaatatttttggctttgcaagtcatagtgtctttgttgcaatttctcaactctgccatggcagccatagacagttcataaaccaatgaacctggctgtgttccagtaaaactttatttacaaaacaggtggcaatattcaggtagtggtagtggtgggaagagtgaacagctcatatttggttttcatttctactaacatggattggtctttagaagaaaattcattttaagtattcactatcaatgaatatttgaaaagcgcctcatttaagtatttggtttttattttcatacatctcaaatcaaattaaagaagtatcttaaacagataagatcttggcttgaaaacaagcatggcctaagggctaaaaccaatgattttattatctttgctgttatacacaagggatttttttcccctcagtttaatcacagatattctgctaaagaagataagcctttgtccagaggctgggcttatgggggcatcgaattatggaattaacctggaaatcaaacatagatttgttttgctgttaaggaaataactgtgtttcaaactgggagaatttctcatacttcactggctctgcctgaaaccataaagtaaaagctaagttagcaaatactcacctgtggcttctcttggaatttaatgaaattaaatctttgaatccacttgatgttccatctggggacatgagaatataagactaatatatagaatttgggaatagtcttccattgtttttagagctagaaagaaacttaagtggtcacctcatccaaatttctcactacctaaaagagatcctgacactcagagcaattcttagtaattttttttccacttattcacttgattttcaagtgaattttcaaggccccaatgattttcacttcccggtattcattcccctgtctagtcccctgccacactgagtaaggcttaccactgtaactaataggatgctatggaaattctagattatgacttctgaggctgggtcataaaaaacattgtggcttttgttttttggataatgttcactctgggggaagccaaccaccacactgtgagggcattcagggagctcacacagagatccacatgtgaaggaactggggccccctgctcattaggagtaccatgtgagtgcgccatcttggaagtagatccccagtgcagccaagctttcagatgaccgtggcccaggctgacatcttggctgcaacctcacgagacactgatacagaaccacccaaataagctgtttccaaactcctgacccagagaaatggggagatagcaactatgtctggggatgatttgttacacagcaagaggtaactaatatagctattagagcatgcccaggtactaactgagtttggtaggagggtatataactttgtgtggtttagtggttaagggtgtgagctctgaagtatgacagtttgattttgaatcctggcttggccactaataacttgcaaccttgggcaagttacttaacatctttaagcctcagtttaattatctgtaaaatggagctaatagtagtaaccatcctatagggtttttgtgaagattaaatgatactatatatttaatatctaatgttatctagtacattttataatctaatattagatacataatattaatatgtaatattaaatattaattatatctaatattaatatacatttatagttatatattataaattatacatataatatattatataatatttatataatatatatcaatatgtaatatataagtatatattaaattatatatacttatatatatgttaatattgtatatataatatcatttaatcttaaccctataggatggttactactattatatatatatataaaatgcttggtatagagtgtggttcatagtaggcacccaataaacattagctattagtccttgcttttgaggagctgggagagagagacttgttaccaggtcatttagaagacatcatggtgagtgtgcaacagaagggtgtgcagtgcattctgggagccacagtggaggggcaattaagcctgggggagtcaagattggattccctatgaaactgatgtttgagtggactttggaaagaaaaagaaatttctctgggcacagaagtgagattagggcatttaggaagaagcactgttgtttggtgcaaaggcgcagatatggcagaacatagcacaggaacagactgtgagatggccacaaatgctggggcacagcttgcactggtggaagagacagcaaagggagtgatgggagatgataagtggaaggaaggctttgtgggtcatgtcaaagaacaggccagagggagctagtatagtttttttgcggggaggcaaataacttaagttttacttctgtattggtctgttttcacactgctagtaaagacgtacccaagactgggtaatttataaaggaaagaggtttaatggactcacagttccacatggctgggaggcctcacaattatggcggacggcgaaggagcagcaaaggcatgtcttacatggtggcaggcaagagagtgtatgcaggggaactcccatttataaaaccatcagatctcatgagacttattcactatcatgagaacagcatgggaacaacctgcccctatgatttaattacctcccactgggtccctcctacaacatgtgggaattatgggagctacaattcaagatgagctttgggtgggaacacagcctaaccatatcaacttccttaatcctagtattaaagatcatggtctggagagggacagattgcagccactaagaccagttaggagttttgcaaatggctcaagagaaggacggggagggcctaaacttaggcaatgacaggggtgaggaggagtaggaagtttataaatcatatcccaggagataattgtcaaataactgcataatgataatacagatagcacagtgatcctcccttatccatggttttgcttttcattgtttcagttacctatgggcaaccaagttctgaaaatattcagtggaaaatgccagaagtaaacagttcctaagttttaagtcgtgtgccattctgagtagcatgatgaaatctcttgctgtccagctctgtgccacctgggacgtgaatcatctctttgtccagtgtatccatgttgtatatgctacttgcctgttagtcacttagtagctgtctcagttaccagatcaactgtcacagtgcttgtgcccaagtaacccttatgttacttaataatggccccaaagcataagagtagtgatgctggcaattcaggtatgccaaagagaagcttcctttcagtgctaaggtgaaagttctccacttaaggaaatttaaaaagaaatcatatactgaggttgctaagatctacagtaagaacgaatcttctatacatgaagttgtggaggaaaaagaaatttgtgcattgtgtgcgtgtgtgtattagtttggtactatctgaggtttcaggtgtccaccaggggtcttggaacatatctcccaaggacaagagcggggactactgtacttttctaacttttccactagggctttacaggacttccatcaaatggagattataactgttctgtgcagctaggctttgctgaggaaccattaatatgccaaccattatgccaggtactttaatgtatgttatctctaatcttcacaacagttctataaacttggtattatgggctcattttacagaagaagaaactgaagctcagagaggtgatgcaacttgcaaaagactgcaaaactagcaaattgcagagctgggagtataacccagcttatctgattgcatcctgtttatcgtcacactacactgttcaaaactggataggaaatgtgagaattacagtcacgtgataggctgggtgcagtggctcacgcctgtaatcccagcactttgggaggctgaggtgggtggatcacttgaggccaggagtttaagaccagcctggccaacgtggtgaaaccctgtctctactgaaactacaaaaattagctgagcatggtggctggtgcctgtaatcccagctactcgggaggctgaggcacgagaatcacttgaacccgggaggcggaggttgcagtgagctgagatcgtgccactgtactccagtctgggtgacagagtgagactctgtctcaaaaataaaaataaaaaataaaataaaaaatagccatgagatgatatacaggaacacactctgaaaaggttaagggtatgatataaatgtgttagagtaatcattattatatcaccccctcacccatgctgctcgttcactggttgggggattgtttctcttctggtatggaaacaagatattatagaatgtaaggcagccaggaggtgagagtgagaagtttagatggtccccaagtcctactgatttcatgtccaaaagggttgtggcatcaagcagttcattattgcctcttctaacgatgctgttctctgcaagctttttggccaagcctgtgatctccttgggtctttagcttatgggaagagtggaggaggggttattctgtaagctagcttaaaaggagtatttagatatactcccccaaaaggctttactttccaaagtttacactgagattttaaaagttttgttaagtgagctgaagttaagtcatgaacaaactttgaatagtttgtgaaattgacagatgatgcacttagcaagtctgtggaacacctgctacaacttttttgtttttgttgttgtgacagagtctcactctgtcacccaggctggagtgcagtggcccgatcttggcttactgcaaccttcacctcctgggttcaagcgattcccctgcctcagcctcctgagcagctgggactacaggcgctcaccaccacgcctggctatttttttaaaatatatatttttattagagacaggagtttgccatgttggccaggctggtctcgaactcttgacctcaagtgatccacctgcctcggcctcccaaagttctgcgattacaggtgtgagccaccatgcccagacctgctacaccgattttaaggcattcttgtcctggtctagttgaggaatttggaggtcctgatacagacccccagtttctgaagcctaaccaaggaggcacctgagaatggtgttctgggtagtatcctgggaggacaaaactagcttcatctggaatgctctgcagtctcatgggattcctgttaccatggtaagtcccagaaccaatgcctgtaaggatgcaatttgccgcttgcagggtatttctaaatgctgttttcagacatagtgcactggtcaggttggctgcagggctggtagtaggaaagcatgaaatgattatcagagtcaacctgattaaagacaggatgtaagcaagccagggtgaggtgagcatagggacctaaaaaccagccatgggaacaggagacaggatgtcagggagaaatctcattaattgaccttgatggtcacagtctcatttgtcttctctttaaaaaatcaattgttttttacccttatttacaaaaggagttcatatttattgtagaaaatctagaaaaattttaagtgaactaaaaatttaaaaagttaatatcatttaaagatagtcatggttaatacctttgttgaataccactgagatgtatgtttatctacaaatattttacagtttaaattaactagactcatccaacagtactactttttccccactgaacattgtaacatgaatattttttccatttattacatattcttccaagtcatcgagtgtagtgttcaattgagaaaacaccttaatttatttaattacttcccaatggacatttaggctgtttccctattgttaaagaaccctctgtattaataagttttgtggctttctgtctaaatctgagaccatttctttagagtaaattcctagaagtggaggagttgctgtatcaaatggtatgccccatttgagggttttgaaatgcatcttacccaacttctctcaagaaagcagtacaaatttgtatttccagtaacaacaaatgagatggtttaacctttaatgagttgcatcttaaagatactgttggaggaaatgaatagagagactcagttttttgtctaactgatatagggaaaatatcagtcacatttcattcttgagaccattattgcataaccagatatggttcagtgaacccacataagcatttgttgagtacctaccatgctcccaggcctgggctgaatatccctgctgctagtgtcagtttcaaatacttagtacagcaatcaataaatgagaggacctgttggaatatgagtagaatatgagacaccgagctttatagtggaaggaaattagtgttttctttgccagatgttaaactatagcagtggttctcaaagtgcggtccctggatcatcagcatcgcttgtgatagatggggattatctggccctacctcctgaatcagagactctgggatttgggcccagcaatttatgttttaacaaggtcttaaccaccaaacttctgcaagatgccaaagattgaggaccgctgagctataaaaaggcagcaaatgcagaagaggtcagacttgttgggtaaaggtggggtgactaacttctcctggtttgcctgggaccatcccagttttagcacagaaagtctcgcatcccaggagccccttctgtcccagctagacagggatggttggtcaccctggtaaagggtggcaggggtgaagggaggttctctttgttgcagcctaaaggtaattatggcagaaaaagaatagaagggccagcagagaaggtttcaagatggagggcagatttcagaagctgctttctgcttgtcagctctaggctgatagatgtggtggcaggaggttacctgcaggaagccagcagatggctaaggcatcttgctgaatcccttgacaggagtcacagctgttagaacttgatactttctggaaaggggaaggttggcattcaccaaactactgcaagatgccaacttgaaaaaaaagccatgattaatcttagcagtgatgacaatgaaatcattttacagcaaaaaccataaccaaaagtgctttgtaattgcagcaatttccatgtcctgactgatggccccctagattctagaatggtgtcgggcttatctgattacaagaactaatcctgaataagatgtaacattcattcttagagtaagcattcatcccggattttctaaagcaggtgcaatttaaactctttttgttctttactacagtcaataatgtataaggcatgtaaagtttcagttttgaaagtatagtgtgcaaaattttaataaaagtaatcatacgttacattgttacatgcatggtgttgatgacagaaagacaggagggctgatttatagatcagttaaacataagaaattccttatttttcctaaaccaacaattctgaacctgttttcatagtcgaatcacctggggagcttttaaaaaatgcttatgttcagggttccatcccagagatggtgacttaataggtttgaggcaggggcttggacatagatattaaacaagcaaaattccccaggtgatgtgcatttggggttgagaatactgtacttaccctgatataaaccaatgggtcccaactttagcatgtaccagaatagcctgaagtgctattcagtaggtctagggaggtgggggtgcaaacatttgcacctctaaggagtgccctggtgatgctgatgctgctggtttgcagaccaagatttgatcaccagtttcctaaaccattcctactccaaaccccagataatcgtacaaaccacatctgtcacccattagctagacatgtgaataaataactccctctcaaaacacttctgcacatctactcccacgtatccagtatttcttttctctactgagtttaaaacatatttcaattaaaaagcatactttagaaagcttggtataggtttaccttcctctttaggtcttgcaaaataggattatttgtcgagtggtatcctttctccctcactagattgtaggttctctgaggacatttgtttgttcgaaggttgcccatgtggcttaggacatcataggtgctcagtaaatgttagtagtcagtggttatgcatagaaattgcatcatcataaccaaacccacctattcccagtagtttttataatgggatctaaatagactgacactccaaaattaggatcataaaacgtattcacttagagaagtcgaagctattgcacaggacaagtaaaataatcaaagaagttagcagaaggtaactacaagggaatttcaccaagaaggacaataatgtagataagatgatatatcagcaatagccctgaaatgtggactgatacatagagtagtttagtaatataagcacacacttaaggcttttgaaaaaaaaataactgtcacaacttgtactggagccacattaatacatcaaaaaatccatgcaaatgaccaaatatcccattgtttgacaaaactaataatgcaacagaatgtattgacatagtccaccccttaacaaaactatcacaaacatccacactgaaagaaaacagacacaggtacacacttaatgaaaaaacccaagtatatttctggagaaagcagctacagcaaatatggaaacagatttagttcaataaacagctgaatgtgtatgctggtccacacatcctcaagcccattgaattttcctttggaattttcccttggtcacctttttttggattgaatttactttgtcatttgcccctggctctgtcacttctgtccagaggctgctgcagggatcctaaatgaacaaattcaatgatgcttattccttcagaggagtcaaaagagatgttgaatttaagaatgaaatgctcctgaaggtagatgagttcaagttgtcttgcattgtgttactacacttacaaaagtttgctatagagaaaggagaaaagcacatggtctgggtttctgaagactggcagtgaaagttggaggcttcctattttgtaaaatctgaccaaacatggaaataacaggaaaagatgtctgagtctggttcatagttgtctaaaatcatcagcatttataagttattaacacatcaatattaaaaattaatattaaattattaatttattaatactttattaatattaaattattattattaatatttaaaaaacttccaaataacatacaattttggaaggtaatgttttaaaaatattttctgtatgataacttttctgaaccatacacttatgaatatggaacttaaaattaatgctgcagtaaagtgaacgcaacaatgaatgtagggaaaatggattaaattagttcaatattctgcaggccgaaggcctttgatcaatattttgtctaattttctctttccagcatatatcacaaacataaaaaggaagaatattccacttttattgggggtcagcagggagggctaagaggatacaggagtgatggtatttgcataaaactggctggactatttagcttgttaatatctgtattgtgattgaaagtttattggaaaaatgtgctgatctcaaaactacactagttcggcaatgatagcaagagaatggaaccaacaaattctttcatctagaaggaaaatgaaaaccagaacttgaataatgggatgtatcttagatctggtactgaatgtggaaaattcaagaagtaatacattggtactactaatagtatcatgtaaggttttaaactttgtctaacaagatgtactcataatgataggtaatgcttcaaccccagtcatccctctgagtttcacaagatacagaatcagttaattcaacaagtatttattgagtgcttaccatgaaccaggtattgttctagctctgaagacatcaccattaaagaatagtaaaaaataaaaatcccttttgtcatggaacttgcattctagttggggaaagacagaaaacgcatacaaaataagtcaaatgtaaactgtcttagatggtggtaagtgttacgatgagttacaaagcaagaaagtgggtagaataacatcctgccccttaaaaaagcactagggaaggggttaatgaaaagatgatcttagcctacatacctgaagcgagccatacagatagtggcggaaagtaggttctaggttaggagaagagaggcgtagggcaaaaggaaaattattccctttttgcatgtccttctatacagtgtgaatttgctaggcctgaatatatttatttatttgttttcttgaggtctgagctgtggaataatgtgctaaatttgttttcttctctatacttgtttgtactaaaaaaaactctaattaatgcagcttacaataatgtgtactgaaacccagacacattgaggcatttaacttttctgggaaagctgtagctaccgtcagggtatgatttatgactataaaagtcaaatagttgagcctggggtaatcacccactgaatgtgattggttctttggcaattgtgtcctaaacaaaagcactctgtcttttatggtcagcattttgctaagctccaactaggttactccatatttactgataggagaattgtaatgagaaacaccagtaaaaaggagaggttgaccccagtagaaaaccaaaagcaggttcttgtggctttcccaggtgcagatttgaaaaagacagtattactgataaataattaggttattacaaagaccaatattttcttttgtcagaattttaatcattgaagtggtataaccacaatttgtatttttgcctgaaataggagtggaatttgctggtgttaacaaatgcaagaacaaaataatactatataagcttagttaactgtttttcaatagcctttagaagaattttctgtaatacacacacacttctttttttttgagatgctaaaagaaattttaataattgttacataacatactgtgtagctatttgatgaaatctacctctgtgtaataattattaaagtaagtcttgaaatgtatgataagaatatattagttttttgggtacaatttccatgaaaaaaataagaaaacaaataaataactaaaataagaaataggaggttttttatacatactgttgtcatcatacaaaattactctattaactaaatttacctgacattgtcaccgttaaaagcaaaatcaagacaaaactaattctcaaatttatttaattttagtaatatattttatttaaccctatatacccaaaatattttcattctaatatgtaatcaatatacaaaaattattaaagagatgttttatgttcttttttcatactaaggcttgaaaatccagggggtattttatttatttttatttagtgtactttaagttctagggtacatgtgcacaatgtgcaggtttgttacataggtatacatgtgccgtgttggtttgctgcacccatcaactcgtcatttacatttggtatttctcctaatgctatccctcccctagccccccaccccccgacaggcccctgtgtacacacacacttatttctaaaagaattaattttaattacacaagtttattatctttggataatcaaaaggtaaaacattacgtttatgtgtagagccctttttacgagccaccaccccaaatcctgattttcttcaaaaggtaaccactgtgatcactttgataggtattttacagacttttaaggaatttacatatgtatacacatatacacacaatacatgtatatgctcacactggtaggatagttatgtaagaagataaatggtatttatatgtctatatctgtaccttgctttatgccaacaacatgtcttggggattatttcccatgctggaattttaagacctacctctttcttttcacttactgcatagcagtccacaatatggttataccataattaattggcctcttatttggacatttagcttgttgcacacttctcaactacaagccatgcagcaatgaattctgtagtgcacttgtgcaagtgatcaggcagtggttctcacggtggcacccagaccagccgcatctgcatcgcctgagaacttgctagatgcaaattcttagccctaccctagacttattgactcataaactgaggatggggcccagcaatctgtagtttaacaagccctctggtgaatctgatgcattatacaatttgaaaaccactggcaggtatgtctgtttctacagacacacatgtacggatacagtcagttctataatgtaacatatgtgttcttaaacaccactgtgctatgcaaaagtatgtaataaaaggcctcggggcttttgagaaaaatgaggttggggcacaacagttaaaaacttcatcagtgacacgttaaaaacaaaagctgggagaccaataaaaatgatagtgcggttttatacatgttaaatgggtaaatacacaaacgctacagtaaatatggcaccttcccttgaaaagaccagaagtttgcttgtgtaagttggtattggaggggttgacccttgtgagtttttgggtagtggcggaaggagggttacatgaaattggaaggtaagttttaacagcagatgtggtgagtgtggctcctgccgcacgtggtgaactgaggcagttggtcatgttgaggtgtgtgtgtgtgtgcattttgggtattcctatatggctcagtccatttgggtgcatttttctgcttttccctagcatttcttgtggataagcaaatgcgaaattggagttatgtccaaattttcccccagtgtatcaatttccttggaataaatttgccttttcgatacaggtgtcacagctgtatgtatggatgcttattcttttgcgtacattacacaaaataactccatacactgtactgaatgctgtttttcacttaatatttcttagagctttttccatatcgccacatagttactcgtttttttttttaatggcatttaaagcattaagagatgactaaattgatctccaaaatgcttgcaacaacctacactcccatcaacatgcttcctacaccttggccaatattacctattatcacatttattaacttttgccaaccactagttaaacgtctctctccttcctctccctccctctcctccctctcctccctctccctctcttccctctgctccctctgctccctctgctccctctgctccctctcctccctctcctccctctcctccctctcctccctctctctctccctctccctctccctctcctccctctgtctcctcccccacctccacagagacatttacactgtgaggaatgcctcccgtaagtacactgatagaaaaaggaactttaaaagtgtgaaacaggtggcgaggtggtgttgaaatggtaaaaaaaaaaaaaaataaataaataaaaataaaaaggaaataaaatggatatgaaagaatacataaaaacctattaaaaaggcagaaaaaaggaattccctttctgcttatttttcacttctacctttgctaaatacaacttatccactttatgagataagatattgagttgaccctgtaggattccatctatcactctagctggttgacatctccaaaaatgcagcttacactattaatccattcacttcagcaaaacatgcctaagggcatcagattcttctgtttatcagtattgggttccttggccccaacaagctcagcagatacagctgaacagagtgatgtgtggtggcttcaactcttgagtctggggcttctaacggcaaaagtgacagacatagaggctcatgcaggtgtcagatgttttcctgtaaagaggttggcaatggacgtaaatgcttccagctgggcacattaccaggcaggataagccataatgatttaataatgaaatcacattggtttatgatcattgttcttattaggaaatatcattgctttttgatgatttattatgtgaaactgagttttcatataaacactgtgatttgcatttatttgtaatatatatttgcatatgtatatatatctgagtgagaatgacttactaaaagtaatcaccaaaaaaagaggatggaatattgatgtaaatatgccacaaatatttaaggaaatgtagaaattatgaagattattatgatgttgccacttcaaaataatattagatgcattttcctttatgtgaaactgacagagaactagtagctggatccatctctgttttgcaattaggcttttgcacctaatcacaaactacgatattattaataaaatataaagaatatatataagggttatatagaaccaccatttcccttctaaattaaggacttgctttcctgtcctcatttctcctcatgtgttctgacatggaggagagagagaaaaaaaaaagttaagaagagggaggaagaacattttgacttatgaaagagctttcagtctcatggggcctggaacagttgctctggagcagtgaaggacactacagaaggcttctctctctctttttggttatgattctttgctctatcagctgtgatgacttgtaagtacagttcctaggatcaacccagggtgcaaaatttagtggtgagttgcaagggcaaagcaaagcatgtctcccactcatctgcactcaatgtcaggtacataatttgggaagcccagtgcaaaataaaaatgtggggtctcttgttccaaaagcaggaaaaaatgccattgagggggctaaaatataaagccttgccctatctttcatgggctttctctttcaacttgtcatggtattgttttatttgctattcagtgctactataagaaaaattaaagacgtaagtcattagcctgagtgttacttttcatctcaatattgtgcaatgtcagttttaaatgcaaacataagagcatttaacttggatgtggaatcaccaaaattacatagtttgtattttgtagcttgtatgtgcgtatgtattttgttcttaccagcatggaggaaatgctgaacaaaactcaactgtttttattttacttcttaatacatgtacattctaccaatactctctacctttggtttactgatgaataaagaaggactaaaaggaaaagaatctataggttattgtataagtctgttctcacactgctaataaagacatacctgagactgggtaatttataaaggtaagaggtttaatggacttacagttccacatggctgaggaggcctcacaattatcgtggaagataaaagaggagcaaagtcatgttttacatggcggcaggcaagagagcttgtacaggggaactcccctttataaaaccattggatctcatgagacttattcactaccatgagaacagtatgggggaaaccgcgcccatgattcaattatctccacctggccccacccttgacacatggggactattacaattcaaggtgagatttgagtggggacacagccaaaccatataattcaccctttctctgtccttttctgtcatcgttttcagtgtaggtgtttggccaatacagggaagtaacaggtataagaaaggttatgacaggattccttggtcattcatgtttcttagaatgccactaccttcttttggtggttgaagcaaattctggtttgaatggaaagtatggcctcttagggctatcagagcttactcagttctagatgtatcgtatttaccttgtatttgtttggcatctcgctgaactcccatgcactatgggcctgatggagtcctgtgctcctggggcattgtgaatgctgtgtgtaaatggggctcctaggaacaacagacacatattgtgcacattttctctgctcacacacacatgttccattgtcccctcatgctccactcaaaaaatacaagttcaaagataaaaatcattaagaatttcaagatagtggcaggagaagattaaactaagtgcaggacccttctctctgtggggcctgtgtgactacacaggttgcacacccacgaagccggccctttctatatcaggcaaagctgctggacagcctgaagcctcatgagcatgccatgtatgaaggagcccagcttacagcaggctggatattgccaatagtgtaccagtgcaaaatggtttccctgaaacctttaatacacttacttatttcaaactcagttgaattgatatcattgagacagctagatctcttagagggctcccagtgccaggaggagtgcctttcagatgggtctttgaaacctcagtgttatagctagaaccaggtactcatcattgaatcaatctctctatatctcttaacattttttccttctcataggatttccagcaggagagctccagaagcctttcttttggggaacagaatatcctcggtgagtaaatgagtacagaaaccagttactgaccaattaggaagaacatgttgctttggtagaggacagaagaaacaaagtcaaaggttattcagcagaaagaagccatggaatctggcgtgggtcgcctgtactcttatcattttaggtatttgttttctgatccttgttaccagggtgtatggctggacaggaaagccatcttacacataggtggctttcatttttatgcatttattctcttacccattaactcatactaccagtatttggacattgaaggattgttgggatttgaattgatgggatgagtctaaaaccattccaggtagaagaaacagtgtgagataaggagggaaaagtgcttctataatggcagagtgtagtttggctagcccaaatggtatatgaaaggaagtagtggaaaagaagattgaggtttgatattggagggctctgcatggcaaataaggagcttggatactaataggcaatagaaaatattgaactttttgagcaagttagtaagataatcgaatttatctttagaaatataacctgtgtagctacagaataagtcaaaattggtagtgtatggacttagggataccagtttaaaggtcattttaataccaacagattgtagactcatgtaattcagaatttccatacatagtagagattctgataatatttgatgtcaataatatcaccatttctattatatactttttacttttgtgttttaatgcttggaaaattttagtcttgattctatacattgagtctcttgtgttttggtttggatatatgacaatttaaaaatatgtaggtttaaaagatacagattcccataaatatatcaataagagaaatatgttggcaatgttttcatttggcctttgggctttcccggtagcagaccttgtggtaagtattcaagtgcaattagttctttcgggaggtggtacaaggaaacaccagtaggggagtggagaattgagacagtgagggaaataagccaaatgaattatgtcctgtgagtcttttatggctgccaaaatgaattactacaaacttagtggcttaaaatgacataaacttataagcttatagttctgtaggtcagaagtccaaactggttctcactgggctaaaatcaagttgtcagcagggctactttcctttctggaagctctagagatgaatctgttttcttgccttttctagtttctagagggggcccacattccttggcttatgacctcttcctccatctttaaagttccatagtcacatctccttctgactctcatcttctgtctctcccttctacttataaggacccttgtgattacactggtaccattcagataattcaggataatcttcctgttttaagttcaactgattagcaaccttaattccgtctgcagcccctttactgtgtaacataacatattcacaggttccaaagattagcaatatggacatcttttgtaggccattattccacctaccacatgtgtgttacaaagccagttatcaccatgggcaactggagctcagtcttgctggggaactgtaaaacatgcttcagagtgatcccatctcagggacatgggagctggggtatttatctgtcctccaactcaccttccatcattgattgagggctcctaccaggggtacctggcagtgcccatcctaggccaagagggctctagtggctggagaaagtcttcaggcaactagtttcaggtgctgacatttgaaggctgtcagattggtgtgctcaaaaatagtgagggctacgaggacgtgggcagccatcgataaagcttactacagggaagcaccatcgttagagtaaataaaaattgcaggttcttatttaaccaaatccattaataatatcccaggcctcagctccatagttttctttggtgttcagatgtttggactcaatttgccctgcttttaagtttagaaatatatatatatctaaaaaattaaaggtttaggataaatattctttaagctcccttcaaactaaaaaagtcctataattctttgattctgcttactgttaacaatttaactgagcttctattattgtggttatatagctggagactaggaaatagtctggttggatttctgaagttattgatgaagtaatttgtttattgggtctgtgagcatgttagtgtctatttgtttgtaccttaggctaggtcatagttaatacttgagtgtgaaagagagtttttttttcctaaagacttgtttgtcctcatccacttaatgaatagctactacatatcatttgggtactcagcattgggaatatgaagatgctaaagacatgggagtcatggtccagtgagatggcttcccatatgttcatctagtctgtattaataaatggatagcctccagaatcaagggagtgggtatcctttctgctcacagtggtcagcttagtcctcacctgagtgttgagtctaattatggggcatgaacaagctgaattgtttccagaagagagaatcaggactgtaaatggttgaagacaacgtttcccaaagtgtgtgttccatgaaatagtaatagaggtaagacatcctcccctcccttcagttttggggaatcataataattatcaccataaaaatttcctagaagctctccaagaaagaaacctatttagatgtgtttaacacaactaccttttttgtacccattaaccatccccacttctgaccccagccccccaccacccttcccaggctctggtaaccatccttcgaaatgcagaggttcccaaactccccggtgttttgggaaatgctgatctagaattcatgactgaagaataagagttgaaagaacttaataacacttgaagtggaacctcataactgtctgcatatttttgaaggaaagttaaggtggtagaacgacttattatattcaggagattcagcaagtgttcagttagaggctacactagaccaatagatgggagccatagaaaagacatttcagatcagcattatggagagctattacgtttagacccgcccaaagaggaaatgggttaccttagaaggggatgagctcttggtcattggaaatacccaagcagggtattataaccatttgaatgggtttttctagagggggcccattcctctagtaggaagttggagtagatgacctctaagccatttccaactcagaaatttttatgaatttatgattcaggcataggacagcccttacttgataacagtgtgagatcatgattaagctagacagcagtatagttgttttgttgttgacagcaaatccggtgcatatgttaaacccactgagtaattagaacaaaagagaaactgagtaggtagtaaaagtggtgtcttctccattttatttttggaagactagatcttcagtgcaagaaatcttccagtttctggccagccagtcaaggttgcattttaaaagggcgagtttatttttttatgcttatttatttatttatttatttatttatttatttatttatttatgagacagagttttgctcttgttgcccaggctggagtgcaaaggcatgatctcagctcactgcaacctccgcctcccgggttcaagtgattttcctccctcagtctcccaagtagctgggattacaggcatgcgccaccatgcctggctaattttgtattttttaatagacatggggtttctccatgttggtcaggctggtctcgaactcccgaccccaggtaatccacccgcctcggcctcccaaagtgctgggattacaggcgtgagccaccacgcctggccaatgacatgctaatttaaatactcttcattgataaaatagaggacatgaatctaatattatgaaatattattattgtcaggcttagtcatataaaattactttttctttgtctcttgtccaaaggattgtgattaagtaactgagaattgaaacttaaaatgattcaatcattttctgaattctctattgccttttgcaaataggaagcttgttggagcagccctgcttaaaggacatttattgcacagcaatttctataagctcccattgttcatgccttcaattcatccagtcaacagcattgactgagggatgtagaggaccaagtacttattctcagagctgagagacctggaaaaactaaatgttgcaatctgcacactgatagctactgccgcaaaaattaacactatgtaaaattacaaatttgtcccacactgctatgatagctctatgattgaaatgaataatttcactcttacttctttaatgaaggtttgcaatgatggaaaaacagtaggaagcattttttcaaatgcaaattaccttacaggaaagaaataacaaaggaaagcattgccaccaaggggaaaaattaaatcttacaccacttccttgggtgtagttgagacaaacagttagcatggtaaggatcatttatgtcctgtaataacatattactttaaaaatttccattccttccagttatgggtcctatctatttgctgggtgactttgatgttgcatgtcaggaactaactgtgagatatttttagcataattgcaaatctcatgaagaatcttcacaataaggattctaagtggtgtgtaattctcatccacaggttgaatgactaaattaagatacatacagatctgtcacttgcatgagatggtaaagttaactaatcagttaaatcattgttactttcttacgctgtacaaggcatagaggatgtagcaatgaacaagtagataagagagtggcctcaatagaacttacatttgagagagaaaatcccagacatacatatggaaaccccattattgatttcttcatatattcttaatatgctttgctatgtaacaaagcaccaccaagcaaccatttattagctcatgattctgtaatttgggcaggactgagctgagacagctgctctgtatggtgctggccggggtcgctcaactagggctggactcacagacaggtgagtgaaggcgacctcactcacctgtctgtgccccagttgggctggctctcgtggctggggcatggcagggcctctctctcttcctttggagtctctcaacttctggggtttctcgcttcttcatttggcctcattccctctagctgtgtagttgaacttctttgcaagtgacttccaagaaggtggaaaatggaagctactaagtttcttaaggcctagacccagaagtcatacctgaccccttccactgcattctgttggtcatagcaagtcccaaggccagtccaaatttaagaagagggaaatagattgtctcttgatgggaggaggggctatgtgcattcaggggtagggagaattgttggtgtccccttttatagataatctaccacatgcttcttcagaggtgaagagaaataatgtggcacctttttcaaatctttgctattcagttgctatcttgtctacaacagaaagaggaacgtgactacctttgaaaatagagtgatcccttttaatctctactctattcctttttttatgactacatttggaaaacaatttaacttctaagactatagtgacttttcaacaagtttccagataaaatatacatgatatatttactgacaggatcttttcaagccctgttctaggtgttcataaatatatagctatagcagataaaaaaatcatagcaatcttaaggctgaaagggactttagaaatcatctctttcacatccctaatttcagagagtagggcactaaggttcatatgtggtaataatgacaatgtttgttagaatttatattttctttgtctatttcaattggaaggtatgtttagattttttacagctttatgggtatggttattcgattgttattaccatggttactagaaagcagtttatcttggctttccattgaaaaaattaaaggattatgctctgagattcatgcttgtaattgtctccaaattatgtattaatgccatagatctctgagttatggtgctataggagtaattgtcggacatgaatttacacatggatttgataataatggtaagtaccggttcattttataagctgctgcttttataataatgttgactatatggatgttaattgttatgattatctttgcatagcagcagcatcatagcttgaagattatccaaagcaatatgattgctgattgaaaacttttcaccgtgtcttgctgtgatggcttgcaataagtaaacaattgttcccattggtgatcggggtagactttaaaaggcagccttgtaatttcaataaaattagctttgcatttagatcaggattgctgtagctgccacaatagttacagagattgatttatagcttctccctttgtcatttattcattgtcttgagatattctccctggaggagcaagctctgctccaacgatgattatacatgctgccaagttaggactcgttgagttaggactctggagcttggctgactggttcccttttacgatttcgaagattatgcaatgcttaatctatatttttctctatactggcttatattctgattattattattattattatcattattgagacggagtctagctctgtcgccaggctggagtgcagtggcacgatctcggctcactgcaacctcggcctcccgtgttcaagtgattctcctgcctcagcctcccgagtagctgggattacgggcacgtgccactatgcccagctaatttttgtatttttaatagagacggggtttcaccacattagccaggatggtctcgatctcctgacctcgtgatctgcccacctcagcttcccaaagtgctgggattacaggcatgagctaccgcgcctggcctattctgattattttaaagtctatactttcctgataatttatataataggatatgctttgtatcccgatgacatttaagcaaaaagaaaaagcagaatatgacataaactaaagaaatggcttcctttgagagtcctcatcatcattaatcagcactcttttctcctttaactttggagtattatcggaaggccacatgaaatctctgaaacttacggattagtagcaaattactatcacatccatacccacacagtgatttacaggcagtctcaggaaccagctgccctaaggcaacgttatatagaaggggacctctttcttccatccctgtagtatctccaacatccttcctggatgcctaccccagggccagagacacttaggctcttctagaaaagtcttcctgtactcccaccagcccttccttaatcacctagattttttgctcccctggtcttcccttctctgttaaaatgtggctgacttgtagttataaatgtggctgacttgtagttatctgactctgcagagctagactttctgcctttgggtgtttggtttatctgagatgagagtcttagctaagaaaaaaaaaagctaatagtcctttcttcgttctggacctctcttgataggaaatttaagtacagttcctccccagaaccttctggagtctttctcaaaggactgaatctaatggtggcaatttcactctgtaaccaatgcttagaacagtgcattgcacatataagtacatgcccggtacctatttaatgattggttggttagtgggtagaggacagtgactccatactatcccagggggtggtgttagtagtatgtagccttgctgaagagttttggattgttccaattaacaactttacttacgggacttttttgtaagctctctgtataattaaatttaaacgatgcctctgattctcatagtaaccctgaatatagaagacagtctagcagcatccaaattttgtttcaaaggctgtagagaaaatgaagagtgagcacatagcaagaaagcatgtgtaatctttcttcccattgtgttttggagattttcattcttattccaagttttctttttagagcaatcttccctgtctaagcaggacagatgggccttccgtccacactagtggctgtggaatgaatcataacagaggttttatgtgtctttcagctcctggcaacttggaggaaacaggttcctatagggctgagtcagggtctatgatcgcacagtatggatgactcactggggctattcctatggatcatttggaatttcactggtagtaatgctctgattgcctccatgggctttctgaatgaagccattttatttcataatccagtgaacactttgggtcaaatcaggtgaagacacagaatccaagattgaataagactagtatatgtaataaattgatgaatctcatttttaaggtgctctttgttccttagaaggaaagaacttcctcaattgtctttatcctttttgccctttttacaattaacctgtgacattggagagaatgcaggagctgatctcaggaagagtgttccctgctgttatgactgctttttgaaggcttgtcgaggtgagggaaaggaaagatgaatttagtttccataaataacacaaatgtcttcgaacttttccttttgctaggtagaaaatatgataaaaatggaaacctggatccttggtggtctactgaatcagaagaaaagtttaaggaaaaaacaaaatgcatgattaaccagtatagcaactattattggaagaaagctggcttaaatgtgagtacaactgtggctaaggggggcaccttgtggttcatttttcctcatttggacattagcttgctttaaaccattggttctcaaagcgtgtttacaagatcaacagcatctgtcttccttgggaacattcttgagtcctaccccatacctgctgaatcagaatctttggggttggggcctggtcatcccttaaccaggcatgaactttttcctgatatattactagggctggaaaaatacctaaatccttgctatgcctcaaatctattatacttgtagatgaatttaggtaaaaatccatgtgcttcttttaaagggaatgtttataaacactgacttggttctcctggttcttaaaccatgctcagcccaagtgagaccactgctcattcaggcagagaaaccagagtctgtatccttgaatggtgtctagctcttttatcagtgtcctggacagccatttctctgcctatatatttttaaatatctacaactgtgacatgagaagacctaaaatgggtgcttctatgtatctctatatagtgcaggggttttcacactgtgaaaattcatctggagtatatgttgcttcaagaaaagcatagcagaaaggggttctagagtcagacatgggtccaaatctaggttcaactagttttatgaacttgggcaagttacttaatgttcctgagtctcagcatcttcatctgtgaaacgggtcaatgtttctgaactcatggatttgttgtaagaattaagtgagcaaagcaatgtggagcactagcacaaggcctgacataaagcaagtgctcaataaaagatcgttagttaatattcctgatccttcgtgacatactcattagtaccctatcccaggaaaaaacaaagccaaagatttttgggttaaaaaccccccaaaaaacaatagaacagctttcttggaggaagggaatttatatttcctgatgattagtatatacaggcatgaagatgaaacttttcacttaattgaaacaaatgtatccccatactagtcctgagaggtatagattattactaagtgtacaggttttacgtatgaggttcaaaggaattaaactgaggttcaaagagattaaaatccacggtagagtctagattagagtttaagtaagtctgtacgactccaaagtccatactgcttcccctatatcatgctgaggttcttattttaagttcattttatatctgggtgatgtgtgggtggactgctcttcaccattcattttggccaaagtgtcagagattgaaacttaattctgacaaatgtgtacctttgtcacaaggacgatagaaagggcatgcctgtcttagcaccaatccacttaaccatcagaaaacagcttcagtttcattcccacaggagagtgggtggcttcctttgtggatataagggccatgctttattatttttctggcttcatttataggagccgttcctttgtgcctgaatcttgctttgtagtgacttcgggggagctcagatggggcactacagatgcagactgtcagcagctgttgagtctttttttgttgttgttccttttcgtagctgttgagtcttgggagtccaaacctagggccacgtggtctactgaggcagaccagagttcaaggagccagaggggtgaggctgctccaaaaggctctaaattagatataaagcttagagtgaatggctgggcatggtgactcatgcctgtattctaaacactttggaaggccaaggtgggaggatcacttgaacctaggattttgataccagcctgggaaacatacggagaccctgtctctacagaaaattttttaaaaaattagccgggtgtagtggtgcatgcctgtagtcccagctactcaggaggctgaggtggaagaattgttggaaccctatagtgagatatgatcacaccactgcactccagtgtgggtgaaagagagagaccctgtctcaaaacacacaaacacacacgaaaccctcagagtaaaaaggaaggagattaaattttttaagcaggagtggatataatcataatcttcaagagccaagaggagttgggacttgagaaagtagcatattaggaagcaaaggctctggagacagaagactgcttgggttcgaatcccagtgacatgcgagcagtttacttcatcactctgtcttaggttcactagaagcagagcccaagaaggggttccttaggtcattgacttttttgagacagcgtctcgctgagtcacccaggctggagtgcggtggtgtgatctcggctcactacaacctctgcctccctggttcaagtgattctcctgcctcagcctccccagtagctgcgattacaggtgccagccaccacgcctggctgatttttgtatttttaatagatacggggtttcttcatgttggccagtctggtctcaaacccctgacctcaggcaatctgcccgccccagcctcccgaagtgctgggattacaggtgtgagccaccgcacccagcccaggtcagtgatttattcagaaagtcgtttcaggaaaaacctataatggaatgagggaaacctattggtttcaggaaatgtttagcctcaccctgattccacagaggattctggagcacgaactgcaccacagaaattgttcagcccaggtactgggttgttcaaactgcacatcagtcaattactggaaggtgggttataacctcccagcggtctccagatgaggtgactcccataagctaaggttgatctgagctgttagcagttgtgggaatgggtgcacagtttaggcagaaaaggggatctggtgggatatcgacatctgctacactctcggagctttagatcctcatttgttgagcaagggtggtggtaattagcacttacttacctcatacgactgtggataacaaagaatatacgtaaagcaggaatggtagcttttgtgtactgaagctaggagggtcctgagtgattacagtgaataatattttccaaagatttgtttttattcattgatattgcttgatacctgggtgactgggctagcttaaaagtaaagtgttggtaagatccatggcttgaaagttaaaagcaaggtatattagttttctgttgcttgctataacaagttactataaacttagtagcttcaaataacataaattatcatacagcgctgtatgatttattatcatacagctctgtatgtcagaagtctgacatggatctcagtggactaaaatcaaagtgtcagcagggccacattcctttgtagaggttctaggggagtatctgtttcctcgccttttctagcttttagaggctgcccacattccttagctcatggccccttcgtttttcaaagccagcactggccggtggagtcttctcatgttgcatcactctgacactcgctctcctgcctcccttttcctcttgtaagaacttttgtaattacactgggtccacctggacaatccaggataaagtctgcatctcaggatccttaatcacatcataaaagtctcctttgccatgctttatttttccagcttcattttgtggggaccattcctctgtgcctgaatctttctttcttcgcagtgaataaggtaacatattcacagattccagggatcaggacgcagacatctttgggaggccgttatcctgcgtgttatacaagagttgaatgacttttctgtaaagggccagatagtaaagaattgaggctttgtggggcgtatggtctctgttacaatatttaattctgccactgtagcaagagagcaaatacagactatatgcatgggcatggctgtgtcccaataaaacttgatttatgaacaccaaaatttgaatttcatataagtaattttcatgtgccaccacaatattattcttcttttgatttttccccagttgttgaagtatgtaacatccagtcttaccttgaagcctgtacaaaaacaagcagcaggttggatttggcgtgtgggctgtattagtttagaatatttgtgtcctagctcatttaaagttttgagaaacaatcttgaatattgggaataattttttttaccatgctggctggttgtcatacatatcgcagacctcgaccttgtgatctgcactacttctgtttgatttttcttccctaggagaaccactttccttttaattttccatggaaattgctgaaggtaaaatgatgatagttggtcttgaaatcttgttcctgtgtggatggtaaatttttggaaacacaggcacaatgagaagaatactcaaattatgtgagttaatcagagaaagtaacctgtgtattgacattcctgttttttcccattaaaccagagtcactcagaatattgttaacattttattggagctggctagattggttagaatgaagaggtaggtgaaaaagaagtgtgtagcataatgaaatagaaagtattacattccagagcaccttgctgaggatagtttgccatctttcttacaatatattatgcctacctctgatttattgaatgtgattttctctttaaaatatgatacttttcttgctataatattgatgcctcttgctgaatgatagttgaccgtgaaacacgcattcattttttttttttccttttttctttctgttaggtcaaggggaagaggaccctgggagaaaatattgctgataatggaggcctgcgggaagcttttagggtatgcgctgctacatttaccgtggttctaaaaatcaagccataaaacaccatatgggggtacctcaattcataccatagccatgttcttgaggagttagttagttagatattatggaatttctgtaaatagaagtgtgtctccccattgaccctattacataaagagaactatatttcttttttctttttggggtgtgaagtcaccctaaagaataatatttgttattaagaatcatgtatttaaagaatagcttttagaaaatacattcaccatcagatcgaagcatgctacagcaatctccttggggctaggttcatttgttttccttgagtacaggtctttctgtagtcctcctataaatttctcttaaaatatcaaacttctaaattatgaccagagggtagtggttctcatatactgggccaagtgatagttcataataacgttttcatcatccactagtttgtggtcaaataagaagcataaagataatacagaaagatttcataaagctaaatgcattaaatttaatgactagactgttattcctggttatatccttcctatattctagttgaaatatactttattttataaaatgagggcactagaagatgataggttttctcttacgtgtcaaaatgaaaaaaggtaatatgcggaccccaaaatgtattgccataggggccttgccattgtgttagatttgtttgtcccctgctaggaatggaaagaacagctttttttctccaagagttatttaacatctgaatgctttggtccagctgctttggtatacattgagcataaggcctttttgcaggtgtacctgcctcactggtaagcaacaggacatggacttgtgtttcttaagaaaattttgacatgatgcattttgcacgtggcaggagtatatatttgctattcctgtgctagctgagcaaagagaaaaacccaccgttgcagagactcatctcttcttcttctctcaccaggcttacaggaaatggataaatgacagaaggcagggacttgaggagcctcttctaccaggcatcacattcaccaacaaccagctcttcttcctgagttatgctcatgtgagtagactgaggaaggggcatcagggatgagatgcaggacttgagtttgctcccttgatcaaagaaagatttcaaacaaaagtttaatggcatgactttgattttcagcaaaaatgttatcttgattattttcagggtaaatctcatcttcttaatgttctgtagtacataattaattaactgattgaatcaaggtttattagtattttttaaatcaaatgggttagcagccctgtggtaattcatttgatagttcctcaatgtatcttgacttcttaatgtgtttgatactatttatttgtaaccatttctagtaacttgctctttggctttcatgggcctgctctttcctatattgctcctcctttgcctcatttgctgactttatgccaccactctcagcctgtgggggaccctcagggtcatgttcccaactgtctaatgcatatgcagagacccctagagctgaaaaagaacaaaggcaaggagagtcatgtcactcttttgtgagtttaataggctcttggagcagaaattgaaaggaagatgtacacgaaataaagcacagttccgagcctgagtctctgtctaatgaggcaagtgccaaatctttattagctattatactggtttatgtcataaacatacgggcagccttttcaaagaagtcagggataggtcaataaaggttctagtgaatggcctcaccgtgggcaaatgtgtatgaatatgctcaaagctagacaaaaattttcatcagtacaaccttttgttcctaagtctgtctttgctttcactgctaagtaagctcattctcacacgagtcttctataattcactctggtcacaggattcttgcttgcctgcggtcttttatttcttaaagctaataaaaaacactaaataaattattatttagcaacctaatgtcaacaaaactcaactctagtcatccacaacatgactttccttttacttttcctgtttctatcatcacatcccatctttagattttcctggttagaaagcctggattcttaggtcttatttgatgcatctgtcctcaattttacaacatgtattccagaagccagatgtttcatactttactttactttaaaaaaaaattatactttaagttctggggtacacgtgcagaacgtgcagttttgttacataggtatacatgtgccatggtagtttgctgcacccatcaacccgtcacctacattaggtatttttcctaatgctatagctcttctagcccccaaccaaccctctgacaggccctggtgtgtgatgttcccctctctgtgtctatgtgttttcattgttcgactcccactcatgagtgagaacatgcggggtttggttttctgttcttgtgatagtttgctgagaatgacggtttccagattcatccatgtccctgcaaagaacatgagctcatccttttttatggctacacagtatgccatggtgtatatgtgccacattttctttatccagtctagtctatcactgatggacatttgggttggtgccaagtctttgccattgtgaatagtgccacaataaacataagtgtgcatggcatctttctttatagtagcatggtttataatcctttgggtatatacccagtaatgggatggctgggtcaaatggcatttctggttctagatccttgaggaatcgccacactgtcttccacaatggttgaactaatttacactcccaccaacagtgtaaaagtgctcctatttctctacatcctctacagcatctgttgtttcctgactttttaatgatcaccattctaacaggcatgagatggtatctcatagtggttttgatttgcatttctctaatgaccagtgatgataatgagcatttttcatatgtttgttggctgcataaatgtcttcttttgagaaatgtctgttcgtagcctttgcccactttttgatgaggttgtttttttcttgtaaatttgtataagttctttgtagattctcgatactagccctttgtcaaatggatagattgcaaaaattttctcccattctttaggatgcctcttcactctggtggtagtttctttggctgtgcagaagctctttagtttaattagattccatttgtcaattttggcttttgttgccattgcttttggtgttttggacatgaagtctttgcccatgcctatgttctgaatggtattgcccaggttttcttctaggatttttatggctttaggtcttaagtttgtttaagtctttaatctatcttgagttaatttttgtataaggtgtaaggaagggatccagtttgttttctgcatatggctagccagttttcccaacatcatttattaaatagggaatcctttccccattgcttgtttttggcaggtttgtcaaagatcagatggttgtagatgtgtggtgttatttctgagggctctgttctgttccattggtctatatatctgttttggtaccagcaccatgctgttttggatactgcagtcttgtagtaaagtttaaagtcaggtagtgtgatgcctccagctttgttctttttgcttaggattgttttggctatatgggctctttttttttttttttttttttttttttttttttggttccatatgaagtttaaagtagttttttccattctgtgaagaaagaaagtcaatggtagcttgatggggatagcaatgaatctctctctaaattactttgggcagtatggccattttcacgatattgattcttcctatccatgagcatggaatgtttttccattggtttgtgttctctcttatttccttgagcagtggtttgtagttatccttgaagaggtcctttacatcccttgtaagttgtattcctaggtggtttattctcttagtggcaattgtgaatgggagttgactcatgatttggctctctgtttgtctgtgattggtgtataggaatgcttgtgatttttgcccatcgattttgtatcctgagactttgccgaagctgcttatcagcttaaggagattttgggctgagacgatggggttttcttaatatacaatcatgtcatctgcaaacagagacagtttgacttcctcttttcctatttcaataccctttatttctttctcttgcctgactgccctggccagaacttccaatactatgttgaataggagtggtgagagagggcatccttgtctggtgctggtttccaaagggaatgcttccagtttttgcccattcagtatgatattagctgtgggtttgtcataaatagctcttccaattttgagatacgtgccatcaatacctagtttactgagagtttttagcatcaaggggtgttgaattttgtcaaaggccttttctgcatctattgagataatcatgtggtttttgtcattggttctgtttatgtttattgatttgcatatgttaaaacagccttgcatcccatgtatgaagccgacttgatcatgtgatggataagctttttgatgtgctgctggatttggtttgcaagtattttatcgggtattttcgcatagatgttcatcagggatattggcctgaaagttttctttttttttgttgtgtctctgccaggttttggtatcaggatcatgctggcctcataaaatgagttagggaggattccctcttcttctgtggtttggaatagcttcagaaggaatggtaccagctcctctttgtacctctggtagaattcggctgtgaatctgtctggtcctcaactttttttggttggtaggctatcaattgctgcctcaatttcagaacttgttattggtctattcagggattcaacttctacctggtttagtcttgggagggtgtatgcgtccaggaatttatccatttcttctagattttctagtttatttgcatagaggtgtttatagtattctctgatggtagtttgaatttctgtgggattcttggtgatatcccctttatcattttttattgcgactatttgattcttctctcccttattagtctttcttgctagtggtctatctgtgttgttgatcttttcaaaaaaccagctcctggattcattgattttttgaagggttttttgtgtctctatctccttcagttctgctctgatgttagttatttcctgttttctgctagcttttgaatttgtttgctcttgcttctctggttcttttcattgtgatgttagggtgtcaattttagatctttcctgctttctcttgtgtgcatttagtgctataaatttctctctacacactgatttaaatgtgtcccagagattctggtacattgtgtctttgttctcactggtttcaaagaacatctttatttctgccttcattttgttatgtacccagtagtcattcaggagcaggttgttcagtttccatgtagctgtgtggttttgagtgagtttcttaatcctgagttctaatttgattgcactgaggtctgagagactgtttgttatgattttctttctttcttttgcatttgctgagaagtgttttacttccaattatgtgatcaattttacaataagagcgatgaggtgctgagaatatatattctattgatttggggtggagagttctgtagatgcctattaggtccacttggtccagagctgagttcaagttctggatatccttgttaattaattttctgtccatttatctaatattgacagtggggcgtaaagtctcccacgattattgtgtcggagtctaagtctctttgtaggtctctaaggacttgcttgatgaatctgggtgttcctgtatagggtgcatatatatttaggatagttagctcttcttgttgcattgacccctttacgattatgtaatgctcttctttgtctcttttgatctttgttcatttaaagtctgttttatcagagattaggattgccacttctgcttttttttttttttttttttttttttttttgctttccatttgcttggtaaatattcctccatccctttatttattttgagcctatgtgtgtctttctttgcatgtgagatgggtttcctgaatacagcacattgatagttcttgactctatccaatttgccagtctgtgtcttttaattggggcatttagcccatttacatttaaggttaatattgttacgtgtgaatttgatcccgtcattatgctgctacctggatattttacccattagttgatgcagtttcttcatagtgttgatggtctttctttacaatttggtgtttttcagtggctggtgccagttgttcctttctgtgttcagtgcttctttgaggagctcttgtaaggaaggcctggtggtgacaaaatctctcagcctttgcttgtctgtaaaggattttatttctcctttgcttatgaagcttagtttggctggatatgaaattgtgggttgaaaattcttttcttttctttgagattgttgaatattggccctcactctctcctggcttgtagagtttgtgctgagagagatccactgtttgttagcctgatgggcatccctttgtgggtaacccgacctttctctctggctccccttaactttttttcctccatttcaaccttggtgaatctgacgattatgtgtcttggggttgctcttctcgaggagtatcttagtggtgttttctgtatttcctgaatttgactgtgggcctgtcttgctagggaggggaagttctcctggataatatcctgaagagtgttttccaacttggttccattctccccgtcactttcaggtacaccaatcaaacgtagatttggtcttttcacatagtcccatatttcttggaggctttgttcatttcatttcactccttcttctctaatcttgtcttctcgctttatttcactgagttgatcttcaatctctgatatcctttcttccgcttgatcaattcggctattgatacttgtgtatgcttcacaaagttctcatgctgtgttttttagctccatcaggtcatttgtgttctcctctaaactggttattctagctagcaattcatctaacctgttttcaaggttcttagcttccttgcattgggttagaacaatgctcctttagctcggagaagtttgttatcacccaccttctgaagcctacttctgtcaattcgtcaaaatcattctccgtccagttttgttcccttgctggcgaggtgttgtgatcctttggaggagaggaggtattttggtttttgtaacttttagcctctttgtgctggtttctccccatctttgtggatttatctacctttggtctttgatgttggtgaccttcggatggggtattttagtagacgtgctgttcctttctgtttgtttgttagttttccttcttacaaacaggctcctctgctgcaggtctgctggaggtgcactccagactctgtttacctgggtatcaccagcagaggctgcagaacagcaaaaattgctgcctgttcttccctccggaagctttgccccagaggggcacctgccagatgccagccagagctctcctgtatgagatgtttgtcggcccctaccgggaggtgtctcccagtcaggatacacgggggtcaggtacccacttgaggaggcagtctgacccttagcagagctcgaccactgcgctggctgtcaggcagggacgtttaagtctgctgaagctgtgcccacagctgccccttcccccaagtgctctgtcctagggagatgggagttttatctataattccctgactggggctgttgccttttttttttagagatgccctgcccagagaggtgacatctggcagtctggccacagtggccgtgctgagctgtggtgggctcctcccagttcaaacttcctggtggctttgtttacactgtgagggtaaaaccacctactgaagcctcagcattggggaacgccccttccccccccaagctcaagtgtcccaggtcaatctcagactgctgctgtactggcagcgagaatttcaagccagtggatcttagcttgctgggctctgtgggggtaggacccgccaagccagaccacttggctccctggctttagaaccccttctgacgggagtgaacggttctgtcttgctggcgttcccagcaccagtggggtatcaaaaaaaaaaaaaaccacacacacacacacagaaaaacaacaacaatgaaacaacaaaaaactcttgcagctagttgggtgtctgcccaaatggccacccagttttgtgctggaaacccagagccctggtggggtaggcactggagggaatctggaatctcctcctgttctgcaggttgcgaagaccgtggggaaagtgcagtatctggactggagtgcacggttcctcaggctcagtccctcatggcttcccttgggtaggggagaaaattccccgaccccttgcacttcctgggtgaggtgacaccagaccctgcttcggcttgccctctgtggcctgcacccactgtccaaccagtcccaatgagatgaactgggtacctcagttggaaatgcagaaatcacccacttactttctgcattgatttggcattgatttcgctgggagctgcagtccagtgctgttcctatttggccatcttctagttcttctcgatgtttcatacttttaagtgcttttcagatttgacatcttctctcctgttttagacagtttgggctgctataacaaagtgtcatagactaggtggcttatgaacaacagaaatttatcacagttctggaggctggaagtctgcgatcagagtgctagtgggatcgagttttggtgagggctttcttctgggttgcacactgccaatttctctctgtgtcctcacatggtggaaagagctagctagctctctggcctcttcttataagggtactaatcccattcctgagggctccaccctcatgatttaattgcctcccaaaggcccaactcctaatgccatcacattgatcagggcttcaacataagaattttgggggatagaaacatttagtccatagcatccccattaccctatcttatcatatatagttagttatcatatataggcataatcttaataaatatcctctactctggattatcccaacagccttatggaatgttaatctgacttcagcatttttttttttaaccactgttatacataccattggaataccacttttatttcattaccaacctgctgaaagaactacagtggctcccaaatgcctaccacattgaagccaaatacctccatctggcttcccaaattttcagtatgatccaactccactcaatccaattcaatttcccataactaactccactgggtgagaaaaaactcagccttagtggggcaagtatcctcacttctaccctacaatgtcatgcccattactgtctctttggctttgcttctgattctccttctataatgcaacccttcctactcttccccttcagatgattattcaatctaagcttcatccttcaggatccatgttgagttccactccctccacatcttccataaactcttccccaaggaccccagtccttattattttcttttatcttcaactccttttatctttcttactttcattaccatgcagttgagtacttaactgctctccaaatgttcaagaattttagttttatctccacagctaatcttctggatccttacacttcctatctccatagcacccagcaaagatgctgggtatattgaagacagttgatatttttagatcaattgcttgaaatgactaaaactaacagttcaactaaggagactcccttttactgggtcagatatataaaataagtatacaaaaatagaactttctagagttgggattggcaaactagggccaaatatggcctgctgcctgtttttgtaaataatgttttattggaaagcagccacattccttcatttattcatgatctgtagctggttttgtactacagtggcagagttgaataattgaaacagggaccttatagtcttcaaagcctaaaatctttaccatctgtctcttttcagaaaaagtttgctaacccctgctctagaggacaaagtatagtgatctatcaatcagttcttactatttacatcctagcccacaatatctctttgtagataaaataaactaattgattgatagtgaagttacttataattctgaaatgtttccagatataataccaaactaaactatagctgactgatttattgtaaactaaagagatagatagatagatttaggggggaaaagtggaaagctattttatatcttatatcactagtgagaaatttatcttggagcttttcccactgacagaatgaagagatttttcagtcttttgcactttaaagtaagtctgcttataaggagtaaaattactttccctcctgggaaggtactaagaaaacagtagcaggcataatgtgttttcagaagtctcttaagtgatatattaagcaaagacaatactatattagagtataagaatataggaagaaataagaaatgaggtaaaatcaaatgccagaaacaacttcatattagccagcttctgaggaaatcaagggatcgcattacaaaacatcatcttcaaagtcaaattcagaaccactgtgactggtggtttatcttcatcaaaagcaacaacatcatatcacctttcctgctttctatgtccctgtagttgctgtgacctctcatttttctcagatattcttctaatccttctacttctttccattctattttctacttatttagtggacatccattgagaaccttcctggtatctataaataatctaactagcctctaatttcttccttccactatacacccctgccagataaatctttttcaaaatctgggttttattattttcctactcaagaatgacttttaaatatagtttaaacgctctgaccaactgctcaggacttcagaaatctgacactgtccttcctctcccactgctgcccgttaggcatcatatactccagcctagctgaatgtctggttctctttcccctcaaacatgtctttgttcccatttccccctccacttagaatatttttttccatatttatgtgtcctagttcaattcacacttgaagaccatatcatacctcaagtcatatggcaagtcaggattaaagtaagtaagttatgctgcagaaacaacacgacaaagtttatttcttgttcactctccatgtccaacatgagtcagcagtggggctcttgtagtttttcatcaagaagttgggttttgggccgggcatggcctgtaatcccagcactttgggaggccgaggcgggtggattgcctgaggtgaggagttagttagtttgagaccagcctggccaacatggcaaaaccccatctctactaaaaaaatacaaaaattaggcaagatggcttaataggaacagctctggtctgcagctcccagcaggattgacacagaaggcgggtgatttctgcatttccaactgaggtacccggttcatctcactgggactggttggacagtgggtgcagcccacggagggtgagccaaagcagggtgggacgtcacttcacccgggaagcacaaggggttgggggatttcctgttcctagccaagggaagccatgagagactttaccaggaggaacagtgcactccagcccagctactgcgcatttcccacagtcttcgcaactggcagaccaggagattccttacagtaccgggctcggtgcatcccacccccatggagcccagcaagctgagatccactggcttgaaattgtcactgctagcacagcagtctgaagttgacctgggatgcttaagcttggagttgggaggggcatccgccattgctgaggcttgagtaggctgttttaccctcacagtgtaaacaaagccactgggaagtttgaactaggtagagcccacagcagttcagcaaggccactgtgaccagactgcctctctaggcagagcatctctgaaaagcagcagccccagtcagggaattataggtaaaacccccatctccctgggacagagcatctaggggaaggggcagctgtgggcacagcttcagcagacttaaacgtccctgcctgacagccagcacagcggtcgagctctgctaagggtcagactgcctcctcaagtgggtcccggacccccgtgtatcctggctgggagatacctcccagtaagggctgacaaacatctcatacaggagagctctcactagcatctggcaggtgcccctctgtggacaaagcttccagaggaaggaacaggcagcaatctttgctcttctgtgtagacttcactggtgatacctagccaaacagggtctggagaggacctccagcaaactccagcagacctacagcagaggagccctgagttagaaggaaaactgacaaacaaacagaaaggaatagtagcaacatcaacaaaaaggatgtccgatcagagaccatatccgaaggtcaccagcatcaaagaccaaaggtagataaatccacgaggatggggagaaaccagtgcaaaaaggctgaaaactccaaaacccagaacgcctcttctccttcaaaggatcacaactcctcgccagcaagggaacaaaactggacggagaaagaatgattttgatgaattgacagaagtaggcttcagaaggcgggtgacaacagactcctccgaggtaaaggagcatgttctaacccattgcaaggaagctaagaaccttgaaaacaggttagaggaactgctaactagaataaccagtttagaggagaacataaatgacttgatggagctgaaaaacacagcacgagaactttgtgaagcatacacaagtatcaatagccgaactgatcaagcggaagaaaggatatcagagattgaagatcaactcaatgaaataaagtgagaagacaagattagagaaaaaagagttaaaagaaatgaacaaagcctccaagaaatatgggactctgtgaaaagaccaaatctacatttgatgggtgtacctgaaagtgacggggagaatggaaccaagttggaaaacactcttcaggatattatccaggagaacgtccccaacctaacaaggcaggccaacattcaaattcaggaaatacagagaacaccgcaaaaatattcctcgaaaagagcaacccaagacatataatcatcagatttaccaaggttgaaatgaaggaaaaaaggttaaggggagccagagagaaaggtcgggttacccacaaagggatgcccatcagactaacaaaggatatttcggcagaaaccctacaagccagaagagagagggggcaagtattcaacaatttcaaagaaaagaattttcaacccacaatttcatatccagccaaactaagcttcataagcaaaggagaaataaaatcctttacagacaagcaaaggctgagagattttgtcaccaccaggcctgccttacaagagctccgcaaagaagcactgaacacagaaaggaacaactggtaccagccactgaaaaacaccaaattgtaaagaccatcaacactatgaagaaactgcatcaactaatgggcaaaatatccaggtagcagcataatgacaggatcaaattcacacataacaatattgaccttaaatgtaaaggggctaaatgccccaattaaaagacacagactggcaaattggataaagagtcaagacccatcagtgtgctgtattcaggaaacccatctcacttgcagagacacacatagactcaaaataaagggatggaggaagatctaccaagcaaatggaaagcaaaaaacaaaaacaaacaaaaaaaaaacagaggttgcaatcctagtctctgataaaacagactttaatccaacaaagatcaaaagagacaaagaaagaagagcattacataatggtaaaggggtcaatgcagcatgaagagctaactatcctaaatatatatgcacccaatacaggagtacccagattcataaagcaagttctcagagacctacaaagagacttagattcccaaacagtaacagtgggagactttaacaccccactgtcaacactactgccaacactagacagattgagacaaaattaattaacaaggatatccagggcttgaactcagctctggaccaagtggacctaacaggcatctacagaactgtccatcccaaatcaaatcaacagaatatacattcttctcagcaccacatcacacttattccaaaattgaccacatagttggaggtaaaacacttctcagcaaatgcaaaagaatgaaaatcataacaaacagtctctcagaccacagtgcaaacaaattagaactcaggattaagaaactcactcaaaactccccaactacatggaaactgaacaacctgcacctgaatgactattaggtaaataacaaaatgaaggcagaaataaagatgttctttgaaactaacgagaacaaagacacaacgtacctgaatctctgggacacatttaaagcagtgtgtagaaagaaatttataacactaaatgcccacaagagaaagcaggaaagatctaaaattgacaccctaacatcacaattaaaagtactagagaagcaagagcaaacaaattcaaaagccagcagaaaacaagaaataactaagatcagagcagaacggaaggagatagagacatgaaaaacccttcaaaacatcaatggatccaggagctggcttttcaaaaagatcaacaaaatagaccactagccagactaataaagaataaaagagggaagaatgaaatagacgcaataaaaaatgataaaggcgacatcaccaccgatcccacagaaatacagtctaccatcagagaatactataaacacctctatgcaaataaactagaaaatctagaagaaatggataaattcctgggcacatacaccctcccaagactaaaccaggcagaagttgaatccctgaatagaccaataacaagttctgaaattgaggtagcaattaatagcctactaaccaaaaaaaagttgttgaggaccagacaggttcacagccgaattcgaccagaggtacaaagaggagctggcaccattccttctgaaactattccaaacaatagaaagagagggaacccttcctaactcattttatgaggccagcgtgatcctgataccaaaacctggcagagacacaacaaaaaaagagaattttagaccaatatccctgatgaacatcaaggcaaaaatcctcagtaagatattggcaaactgaatccagtggcacatcaaaaagcttatccaccacaaccaagttggcttcatacctgggatgcaaggctggttcaacatatgcaaatcaataaacataatccatcacatacacagaaccaatgacaaaaaccacacgattatttcaatagatgcagaaaaggcatttgacaaaattcaacaccccttgatgctaaaaactctcaataaactaggtatcgatggaacgtatctcaaaataataagagctatttatgacaaacccacagccaatatcatactgattgggcaaaaactggaagcattccctttgaaaaccagcacaagacaaggatgccctctctcaccactcctattcaacatagtgttggaagttctggccagggcaatcaggcaagagaaataaagggtattcaaataggaagaaaggaagtcagattgtctctgtttgcagatgacatgatggattgtatattaagaaaaccccatcgtctcagcccaaaatctccttaagctgataagcaacttcagcaaagtctcaggatacaaaatcaatgtgcaaaaatcccaagcattcctatacaccaataacagacaaacagagagccaaatcatgagtcaactcccattcacaattgccactaagagaataaaatacctaggaatacaacttacaagggatgtgaaggacctcttcaaggagaactacaaaccactgctcaacaaaataaaaagaggacacaaacaaatggaagaacattccatgctcatggataggaagaatcaatatcgtgaaaatggccatactgctcaaggtaatctatagattcaatgccaaccccatcaagctaccaatgactttcttcacagaattggaaaaaacttactttaaacttcatatggaaccaaaaaggagcccatataaccaagacagtcctgggcaagaagaacaaagctggaggcatcacactacctgactttaaactttactgcaaggctgcggtaaccaaaacagcatggtactggtaccaaaacagatatgtagaccagtggaatagaacagagccctcagaaataacaccacacatctaccaccatctgatctttgacaaacctgacaaaaacaagaaatggggaaaagattctgtatttaataaatggtgttgggaaaactggctcgccatatgcagaaaactgaacctggaccccttccttacaccttaaacaaaaaatcaactcaagatggaccaaagacttaaatgtaagacctaggaccataaaaatcctagaagaaaacctgggcaataccattcaggacataggcatgggcaaggactttatgtctaaaacaccaaaatcgatggcaacaaaagccaaaattgacaaatggaatctaattaagctaaagagcttctgcacagcaaaagaaactatcatcagagtgaacaggcaacctagaggatgggagaaactttttgcaatctacccatctgacaaagggctaatatccagaatctacaaaggacttacacaaatttacaagaaaaaaacaaccccatgaaaaagtgagtgaagggtatgaacagacacttcttaaaagaagacatttatgcagccaacaaacatatgaaaaatgctcattttcactggtcattagagaaatgcaaatcaatcaaaaccactatgagataccatctcatgccagtgagaatggcgatcattggaaagccaggaaacaacagatgctggagagaatgtggagaaataggaacgcttttacattgttggtgggagcgtaaactagttcaaccattgtggaagacagtgtggcgattcctcaaggatctagaaccagaaataccatttgacccagcaatcccattactgggtatataccgaaataattttaaatcactctactataaagacaccatgcatacgtatgtttattgcggcactgttcacaatagcaaagactgggaaccaacccaaatgcccatcagtgatggactggataaagaaaatgtggcacatatacaccatggaatactatgcagccataaaaaagaatgagctcatgttctttgcagggacatggatgaagctggaagctatcattctcagcaaactaacacaggaacagaaaaccaaacaccacatgttctcactcataaatgggagttgaacaatgagaacacatggacacagggaggggaacatcacacaccagggcctgtccagggggtcgggggctaagggagggatagcattaggagaaatgcctaatgtagatgacgggttgacgggtccagtaaaccatcatggcacatgtatacctatgtaagaagcttccacgttctgcacatgtaccccagaatttaaagtataataaaaaaaaaaatacaaaaattagctgggcgtggcggtgtgcacctgtaatcccaggtacttgggaggctgaggcaggagaatcgcttgaacccaggaggtggaggttgcagtgagccaagattgcgccattgcactccagcctgggtgacggagcgagactccatgtcaaaccaaacaaacaaacaaaaaacttgggttttagagtctatatcttggcatgtgcttctgtggataccacaggagtagaaaagacatacgaggatatgtgcactggccgttagtgtagcatcttaaattgttcttaaggctcttaaaacttctgtcaggttttaaagcttctgccaggaagtaacatatattacttctgcttctgctcacacttcattggccagaacaagccatatcgccatgcccaacttcaaaggagatggagaagtgtacttcagtcctaggcccagactagggtgaagcgagcaaggcactcaggggcagactactaacttctcatcaccatcctcaataatgggtggctgactcattttattgatttgaatgagtatggttaaatttgagaaggactatttcaaacattaaattcattgaatgaatacactggtcgattcctgggcacatatacgattctcttgatttaaagcacttgtctggaaacctttctcacttactcaaattgtgaaattattcacattgataaaaccttctactctggggatcagaataatagatgttattacagatgacggttttatttgatcttctaaaactgtttgtcatccattggttctaaaattgttcctcagtataatttggagcagttaaaacagcagaaaatacataattggaatgaaagctcatttgttgggatgcttttctcttctaggtgaggtgcaattcctacagaccagaagctgcccgagaacaagtccaaattggtgctcacagtccccctcagtttaggtaaatgggcaaatgggtgacggcagtttttaactgtacatctccccccttcctcccccacccagccatccaagggctctaccagataggtgatctgaaaaaaatcccacattgtggacgtgtgatttccattttgcagccaaaaaatatctggccacacggaaactaaatatcttctttcattagtagtaagctggtttagtcagcactctctcacctgaatttctgctgatggtacctgtacatatctagtctagtgctacatcaagtgccagtgagactatacaagactccagaggtaattcggaatccgaatcatagctttagtattacatcccattatcttctagtttttgaaagagtctcagtaaactgcattattggacttactcaactgcttacttttttgtccaaaaaaatagcctttattgtcttaggaaaggatgagatttgatgtactctgccttaaaacacctagcgctctggtttattttgttttaaagaatatcccctttaatacctcttgttctttcacacagtcaaccagcaaacatgaatgaatggccactttctaaatagctctgaacacaaaggaggatacaaagtattattcagcaattataatttatatctagagttagagagtctacattttggctttcaggtgggatcatattttgaaacggtagcttatacaaaaaaggaaaaggattatgaattgcagtcttatttgtcagaatgtataaaacattaagtacaaataaaattaaaagttaatattactcaccctgtactcggtcgtacaggttgacagaaattttctatagtaccggaaagataagtatgatgagaaacccaaaaaccataataatttatatgtattcattctttgtttagggcattatatctggatatctttatatttaatgtttaaacagatccattagcatattgcaagaaagccatctaaaatttcttctatatgttaaaatcttattcttaagatcttgccttagaaatgcttcagaaattgactataaattacccactagcataaaaatctaatcactatgttggaaatttctcccccactgggctaaactgtcatgaaggctgacggtctcgaacgtactaaaatgtgttcccactgaccaatggtgcagatgaactcacacagtagattaattactcaacagataagttttcagaaacttatttcctttaactagttgcctgtaatgttgaattttacagtgcatgcttactaattatcaactgtattctatctttaacacttgcctagggtgaatcacactatgaaatatgcatccctacccatatattcagctaaaacaacaagaggttatgaggattttttggatacagtccattacatttatgcaaatgcccgtaggtaacaaagtcattagggaagaaatagtcagggactgagaatgctgagtctctagtcaaccctttgaacacggagttgagtaagaaatagaaggggggaagttttttgtgtgtgtgtgtgctggcttgttactgaggtctgcagtaactatagattttgagtgcagcagaaatcacacaatggcaataccacttccaaaaggcagctacaatcaaagtgctgagtaggaatccagtctttgctgtagttggaagcctgtaagaatgtgacatattggagctaactccagtgaagaattatcagtaataactagataccattcattaattgactgattgttgcattaatcaaattctgggcaactgtgagcttcccatacctaacactaattcagagaaaatgttttgcagattgaatgaattctttaaaaatagctggaaatgcaacaacatggatgactcttatagacattatattcagtgaaagaaatcaaagaccaaacagtacataccatggattccattcacatgaagttcaaaatcaggcaaagctatggcaatagaagtcagaatagtaggttatcttgggagatgctgttggtatggaacaggcaggagccttctgggtgctggaatgtcttgatctggcagatagtaatatgggcatatacacacaaaaactggcaagtcctacgtttaatattttgcatactttatgtcagttatactttccataaagtttttaaaaagttagaaaaactaatattggtgatgatacagttttaaaagaattttgaagactgttcgaagagtaataggggcatgtgcttggcattcaggagatgctggatctagtctgttaattttttctggaaatttacttaatcattttgggctttagttgtctccctgtaaacagattaaaagaatgccaaccttctttctagcaatattctgctacagttttatacagaacctgttgatgtgcaagaattatatgacatatgctttgacatatcgtttttcagggtcaatggtgcaattagtaactttgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggagactttcatttttagtgcattttcattatttgggtaggtgacctgcttggatctagacagcatctgttcaaagttgtagggcttataaagtggaatataagaatgaactaagtatgtttctttagaaaatcaaaccaac

SEQ ID NO: 3296 - DNA, 218868 bp, human; identical to SEQ ID NO: 3294

SEQ ID NO: 3297 - DNA, 215284 bp, human; identical to SEQ ID NO: 3295

SEQ ID NO: 3298 - DNA, 210242 bp, human
tatttgagcatgtatcggaatcacctggggggcttgttaaaccgcagatggctgggccccacccccagggtttctgagtcaagatcttggagtggctttctaacaagcttccaggtgcagcagcagcagctgctgctgctctagagaccacactcttaggagctctggtctagttatactcacttatcttacgtacgagagaactgagtttcaaagcaaccaagagtcttaccaaggttatttagctagcagctagagtctggtttcgtgacattgaaccaactgggttttggaataccgtgtcaacactgagaaggatgaactgatatcaaatatcttgcgtatgtttccgagggtggtttaccggatggtggtctgctacaactcagccatttattgtggtctgttttttcagtgagtcaaggtctcttaagtctccaagctaaacaggagtactgcctgaagccagaatgcatcgaagcgggtaagtcacagttttccatcctgtgtcaagttataattatggtaccttgggaagtggaagagaagacaggtggtatttttagtattctgtttgcttgaggtttaccaagtacgaaatgcaattttgaagaaattttaagtttattttcaagttttggtgtgaaacagtggagcttaggtttcctgttttctttttccttgcaaaaactgtggtattctaagcgttgttacaaggaaatcaggaaggggcttggaaggctgaatggcctctcttaagacccacaggcagagaacattggtcttcctatggctccgctggctatgaattcctctttaccttaagcagttgcctatcttctggtctgtgggtctgacttgcctgcctctaagcaaggctcctttgcaaataaatccacgcttccattgtcagtgggagtcccttttctcttttttaaaaattgagacggagtcttgctctgtcgcccaggctggcacgatctcagctcactgcatcctccacctcctgggctcaagtgattctcctgcctcagcctccctagtagctgggattacaagtgcccaccaccacgcccggctgatttttgtatttctagtagagacggagtttcaccttgttggccacactgatctcgaactcctgacctcaagtgatccacccgccttggcctcccaaagtgctgggattacaggcaagagccactgtgcccggctgggaatctcttttttctgtcacacgttgcaagtcaaacttctcttgaggtgaccaggctgtgtatcagtggatatcccagggtgaagatgagtgtttaaagtggccgcagttttgccacagtgtcttatcccatcaaactcatggctggagttgccccaaaagcagcaacagggaaattcccatgagggaatatcccatcccgagatggggccagttgggattccaaagaaagaagcactaaataaatgccagggcggccggtcagtccaaagcatttattagtgcaacttatgttgaaagtgctgcagtgtatcctcaagacagtgagagaaaaggggtgttctacttagggcattagggtgtggagactatatgcgggtttaaggaatttggctcagagccggtactagtttctttcagtgttttgtgcatcaacctagatacctttatcagtgcctgggaatgttcaagggtccagtctggacctaagcctgctgggaaaaaccagcagctggaattagccgggcatggtggctcatgcctgtaatctcagttactcgggaggctgaggcatgagaattgcttgagcccaggaggcggaggctgcagtgagctgagattgcaccattgcactccagcctcggtgacagagggaacttctgtctcaaaaaaaacaaaacaaaacaaacctgcaggtggctgggtcacagagtggtcaggggattgtgtaatttttggttaggacaccgaaagcggcggtggggaggtgaggggaaacctgggggtcccacacacagctattagatttccctcctaaatcagtgttagggcctagatttcagggagccagattctagccctcaccctcattctttaagtgggcagggacacttttttcctttttccaaaaggaaagtcatcaaacaagcatgtggccctttcactttcctcttggccttaaaaggttaatgaacaaattcaccaaatatttgttgcacatgaggtactgagttaggttttggaaatagagcagtgaaccaggtatgggaagaaagacaataaggcaattaatacaatgagaaaattatgaaactgggtgtggtgacacgtgcctttagttccagccacatgggaggctgaggcttgagccctggagttggaggccagcctgggcaaattagtgagaccccatctctgaaagaaagaaagaggaatatcagtcagtggaaaatgttatagagaaaattaaaaaaaagatagaacaatgtgatagcaagtgacaggatggctagattgaaaagccggaggacatgaccttggaggtgacctttgaatgatgaggagggaactgctgtgtgaagactgaggcaagggctttccaggtggggggaacagatggggcaaagggtgcatagaagcatgaacttggtggacttgaggaacgggaggagcttgctaggtgaggtgcaagtgatgaggagtcaatgggggacccaagtgccagtgagtttgggctttccttaagtgtgctcgaaagcctctggaggcttttatgaaagagaatacatcttaggagcatttcaaaagatgtctcggtggagggctcagttagagggagtctttcttgatggagaagagaccatagggagcaagaatagaagaaggtgactcaagtaggtttatttctgtacgccaggtgacagacgatgctgtcttgaattcaagagatggagagggagaatgggggaaggtttaggaggtagagggcctattgaaggattcgatgcaggctgtgaacaaaagcagacaattgtgggtgacgcttagatttttggtgatggttgggcagtggtgtttattgagatgggaaacacttaggtgaaagagcttgtaaattcggagaccttatacaaaggtagtggcttagataattatgttagtagagttctttttttgttccattcttaagtgatctctctctctctctctctctctctatatatatatatatatatatatatatatatatatattttaaccaggctgtgtgttgagtgccttacaggcaccatctcataaaaccttcataagacccctatgaagtcagtgctatcaccagcctcactgacagatgaggaaatggaggcttctggaggctaaataactgcccagggtctcatcctgagttagtagcagagctggacttcgtgtccatgtctggctcctttccgtcttttccttggtgatatggggccatgccaggcaactctttttggccctggaactatctgagaactcccaggccctttcctgctccaggcttgagtagttgacctgaggttttctccagtggtgagagattgtcatggagtggggtgagagagcaggcggaactatcaggacaggttttagagtttatgtcacctggtgctttggctgtggtggggttcttgcagatgtgtgaaatgggaatttttgagctcataaattttcaacttgagtttagaacacttttttgtatggaaggccacttatttcatgagttttagttctgtattatgaatcataataatgcaagactaaaacttacagactgacattcaaagatgttgccttctgccagctagtgtgttctgccttgctgtcctgtttttaattttcacattggcgaatggctttctaatgttgaaaaaaaatattgattttgctgtttctggagtgaaaggctcaccaaagacccagttctctttagtgtaacgtgagcctcagtgtgcccaggggtctgcagaacagctgtgagtacacatggcaggagaattacggccaagccagggccttaaacaagaggctgtgcgtgcgtgggcgtgcatgctgaaagttcagaagactagagtgtttgatcgccttctggaccatttctgagcaggtgccaaccacttctgagatgcttcctctccataactctcctcttctctgtgtcctcttattttaatccctctttcaaaataagagctgtgcaaagaatgcaaagaaacaaggaaagggcatgcatgctcatgatcacagataagggcagacaggctgactgggtttgaagcatgatttagctatttacaagccacatgatcctgggctaaatatatagccacgctaagcctcagtctcaccaagtgtgaaatgggaataacaggttttacttatactagtcgtgagaataaaagaaaataataatggactgggcacggtggctctcgcctgccaccccagcactttgggacgctgaggcggacagatcacttcaggccaggagttcaagaccagtctggccaacatggtgaaactccatgtctactaaaaatacaaaaattagccaggcgtggtggcgcaagtctgtaatcccagctacctgggaggccgaggcaggacaatcacttgaacctgggaggtggaggttgcagtgagccgagattgcaggttgaatctgcacttcaaccccaagggggaggttgcagttcagcctgggcaacatagtgagactccgcctcaaaaaaaaaaaattagaaaaagaaaataataatggtagtagcagtaatttaggttcacaatgctgattcttaaccccaaacccagaaaacgatgtaactctcagttggcaagatgggggcctgatctcaattcctttgatggcaaaattggatcttaactcatgtgaggctgcttcagatttcatttatcctacttacaagaatatgcatatgtttccctatagaaacattaatgcacttgcttcaggcctgccactccagccattgctgaagtattacatgatctgtggttatatgcaatgtatttattttctaaaatctgaaaaatctatgagctctgaaacatatctaacctcaagagtttcagataagtgattgtggaattacagttcccagatttagctaactacatacatacgtacatacaggatgcttagtgaaatttgattgcagatacacaatgactactttttctggtgtatgtctcatggactatttggtacctacttattctaaaaggtggttgtttatcagaaattcagacttcactgggcatcatgcatttatatggtaatgtgcccaacactattctaagcactttacatatatttaatttgcataatgattccatggggtgctattattatccccattttcaggtgaggaaactaagacacaggttaaatcacctgcctaaggtgtcttagctgctgcatggtgtttctctcattcaaacacaagtggtctgactagagtttgtgacgataccatattgctaaaaaagggcttagcgtaggtcctggcaaaaaggaaatactcaatattggtgattttattattgttaattattattattactactctctcccttcatccttgattaaatctaaaaacagaggctggtatttagggaggatgcctccacctctaccacacaaacagcaactggtgactgtgtgacaattaaccttatatatagtgacttggaagagtacacagcctgagctttcacagatttccttcatcatcatatttcttttattaaaacaagactctgggttttctccatggagctgagtagggggaaaggcgttttggtgtcttgacaactatggtcccttgcaatttgaagtcacagttcccctgcagaaagtgcagccctgtgccccgctgtgaattgtgaatgatgaattgggaggctgcaactagagttttctcactcagcaggcttctttccaaattcaatgtgagtgatgtatttcccaacttttgtatcagggccaaggtcagagctgaccttgcagtttttctaggtacctgcaagaatactggcgagatggagaggatacatttgagggttgggggcagggaaagtttgagaaggaggctggaaaacagtgtactcatgtgggtaaaaatgcgtgtgagggctcccctgtgtgactgtaaatgttgtgtgggactgagacgtgtgatccatgtctctgaggtgtcacatagcagattcattctgtggctgcatacagtaactataaataccaaccaaaagaaagattttgttatgtcctagcacatttgcacattaaatattaatgataaaatagtagcagtaagtggccgggcacggtggctcacgcctgtaatcccagcactttgggaggccaaggtgggtggatcatgagatcaggagatcgagaccatcctggctaatgtggtgaaacctgtctctactaaaaatacaaaaaaaaattagccgggcgtggtggcgggtgcctgtagtcccagctacttgggaggcagaggcagcagaatggtgtgaacctgggaggcagaatttgcagtgagctgagatcacgccactgcactccagcctgggcgacagagcaagactctgtctcaaaaaataaataaataaataaataaataataaaaaataaaaaagtagcagtaattaaaaatgtaattagagacaactgatgctagttctgaagcacgaaaatgttaagccaatttgaaatttatcaaacttctaagtctttatttttatttatttttttatttttttaagagacggggttttgccatgttgcccaggctggtctcgaactcctaggctcaagtgatctgcccacctcagactcccaaaatgctgggattacaggcatgagccacagtgtttggcttctaaaccaattttttgctagtgttttttttttgtgtgtgtgtgtgtgttgttgggggaggtttgaaaatggtggggattttgaggccctatagaaattagaatgtttttatattattcacttcattgaagacaaaaggctgtttgaaatttttgtagaaagtctaggctggagaaatatctagccttatttttaaacctggaggaaccacacatgtaaccaaactgtaagatatgtatctaaattgacacagattgtacttttttggggcagttcattcatatttagctgaaatctctttgggttttcattacttcaaacaaaaatatattctggcattatttaaagtatgaaaattgcccagaatgtcatcttttcaatgtcattaaaatattgtctggttttttaaaaaaatcaattggtacataactttgtgctagaatggtagccagcaattgcatggcagctggaagagcattggagttcaatattgggaattctcattttgtaatgaagggttttcttttaaagttcatggttacatatttatgcacacatctcctacctgtgggttatcttctatatgtaattgtgtatgggcttatgaaagaggaaaaaaatggtagatcagtctattgtgtctttctgttaacttatacacatactcagttctactgctagacctgggtccctcatttagaacaccctactttggccctcctctggccatgcctctccttcagccaaggcgtctgtggagccaagtaggcagccctctccttctacaccccagaattccctgcctgatggccccaagctcccttccaggatctctgtgagtctcttctggggcttcatttctctgagagttacactgaatatcaaggagctcaagaatttgaaagtattttgtaaatataacttttaaatatttagatagatgacatatgaacttctgtttccattagccttcactgtgaggcaaaccacccaaaccatagaggcctggaacaaaaatgattggatatttctcatgattttgtggatttggtggatggtttctctgccgatttttgcctaggctcatttgtgccactgcattcagctagatgggcgcctggactggaaggcgaatgatggcctcagtcaatgcctggcagttgtgctggcttggttcttctctatgtgtcctcttgtcctccaggaggctgcttcaaagggcagctaaagggctccattcaaagggagttaatatggaaggtgcaaggcctcttaaggcttagctttgaaactcacagaaagttacttctgccaattctgttggtcaaagcaagtgacaaggtcagtccaaattccaggcaggggaaatagactctaccacttgatgggaagagcagcaaggtcactttgcagaaggacaagcaggatagaagaaatagtcacagttatctttgcaaacaattgaccacacgctctatttgtattcttgtcccataccccacagatgttagggatggccctgcaaaaaccagtgatgataataccaccaaacttttatccattccctttttttttttttttttttttgagagacaggttcactctgtcaccccaggctggactgcagtggtgcgatctcagctcactgcaacctctgcctcctaggtttaagtaattctcctgcctcagcctctgagtagctgggattacaggcatgcatcaccatatctggctaatttttgtatttttagtagagatgggttttcaccatgttggccagactggtctcaaactcctgacctgaggtggtccacctgcctcggcctcctaaagtgctgggattacaggcatgagcccttgcacccggcctatccattcactttgaatgtagtcatttcatatagtgaggtagattcagagagtttatttaaggggaaatataaatgccaaggcttggaaactggttgatatggaattgttgtttaatttggaaaagaacagtatacaacattcagtgcttgtcattaatcctatgattttctttctaaatagctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaagggtaagtttctactggggtttggtgatacactttatagagagcaatatttgacaggaaaaacatagtttgggatttgaagcatgacttctcactttttaactaccatgctaaattcatttccaagaatttttaaaatgaaagattgaaaggaaagtttgcagaattctggactcccagatctcaacataagactaatgtaggttgttatgttcatgtttggtaatagtaaattctactgccaaaggataaagagcatttgattgagattggaagcaaaggaatagttaatgaaaattatatcaatatactcatttgttgtattcagagtaaacttcatttcttgctcattgtgtcctggattttcatggcttacaaaatgtacttaacacctcatcatcttttgacatcacttttgagaactctggatgaccttgtggttgtcatattgttcttgttaacttctaagttggctctagggagattcacttttctcccatggccactctagcaatgacaagctcacacacacatactcacacgtggatgcatagaaacatacatatgttctcaaatacattcccctgccccccgccaaagttggaaatgtctgttattggaggatattctgttagcattggatctaatttttatgctaagctattggagaaggccacctcaggagggaagtaggaagatttcaaagccagataaggtaattattttgagaaggcaaaaatagtatggtttttttttttggctctttttgacaactgtgagttacaccatgtaacttgcattcagtaacacctacaaagaactcctgagaaattataaaaatcattttcccttcccatttacattttcccaagattttaaatacatgaaaattaaatatgtatcattttacaataagtaaaactcttggcaaaataaataattagatacctattgtcaattgtaaggaaaaatgtacttaaatttcacaactagatataaatcacatggacttatattttctattaggagacccaaatttagtcttggaaaattataaatgggaatttacaaggatgtcagggttttctcctaacccaaaaggaaaattctcatactataaaatcataaataagaccttgaggagtgagtttactaatacttttttccctgtagaacattaattcatgttggtctttgatttaccattcttgtccatttcctatttcccttctctggcttttcttaatagacagatgtgtacacacacatgtgcacacacacacacacgcgcgcacagtcatgcatacagaaacattactgaaagataagaaaactacaagatttccaggcatatgctccttttgcatttgttataacccaaagatttctatattcaggacatgaagtggttaacgataacttaaataactttccaggggtgtctggaattttaacataaaagttaaaatcagtgtcaatatgctttgtttgaggagggtactgtctacaggctccttcaaaatcaatagaaatgcaagtaaattgttaagcacagggtttttgtatttgctagcttccttttaaaaatcaaaaattttatttctcagctccattgaagaaataaaaaaagagcaaaaattagaagaaaggtcgctcataaatccgtcacaagaaataactgctaataaagcaactggggatatttctttccaggttttgttgcatgtgtgtgtccatatgcataacttcatatgcacacctatatattgtaaaaattagctgatattatacatactactctaacttaatttttaaaattagttggtattatacatactactctgtaacttaaaactatgcattcctcatagacatagattatgtcagtagataacttttcttttctttccttttctcttttcttttctttcctcttgtcacccaggctggagtgcaatggcacgatctcggctcactgcaacctccgcctcctgggttcaaacgagcgattctcctgcctcagcctcccgagtagctgggattacaggcacttgccaccacgcctggctaatttttgtattttttagtagagatggggtttcaccatgttggtcaggctagtctcgaactcctgacctcaagtgattggcctgcctcagcctcccaaagtgctggggttacaggcatgagccaccgcgcctggccaacttttcttattataaataacactgtaataaacatccttgtgtacacatctttatgtccttatctaaatgtatccttaggataaatttccagaaatggaattattgggttgaaagagtactctaaatttcatttttgatgcatatagccaaattgccttttagaaagtttatttcagctgggtacggtggctcatgcctgtaattccagcactttgggaggccgaggcaggtggattatctgaggtcacgagttcaagaccagcctaacatagcgaaaccccggctctactaaaaataaaaaaattagccaggcatggtggcacctgtaatcccagctactcagaaggctgaggcaggtgaatcacttgaaccaggagggagagattgcagtgagccaagatcatgccattgcactccagccggggcaacaagaatgaaactctgtctcaaaaaaaaaaaaagtttgtttctaggtctttatatttttttgatgttttaaaggataactttttcccatcaactgctttctgtggtataaagtagaagtcatcaaaccattgccagtaggcaaaatccagtccactgcctggaagttttattggaacacagccacatccattcgcttatgcattattaatggctgcttttgcactccaatggtacagtcgaatagttgcaatggaaactggatggcccaaaaagcctaaaatatttactctttgacctttatagacagtttgccaatccctgatgcctagtataaagtaaagctttgaatgtatgtattggattcaattagaactgtcttattagttgatagctccttggtagcttctttgaatttcttagatagttaataaagttaagaaataccagaacaggctgagcgtggtggctaacacctgtaatcccagcactttggaagaacaaggcgggtggatcaccttcaggtcagaatttgagaccagcctggccaacatggtgaaacctcgtctctaccaaaaatacaaaaaaaattagccacgcatggtggaaatcccagctcctcaggaggctgaggcaggagaactgcttgaacccaggaggcggaggttgcagtgagctgagattgcaccactgcactccagtctgggcgacagagtgagacttcatctcaggaaaaaaaaaaaaaaaaaaaacagaacggtgttgaaataatagcaatgataatgggtgtaattttcttatgccttgcttgggtggtaatgcctccagtatttcccctgaaaacgtacactttttttgtttgtttgttttagatagttattcttttttgtgttctgttgttcctagtttgcaaaaagctgctgctcaagaaaaatgcctctttgccatttatcaagagactcagatggagtatctcttttaacttatcttgatttacccatgctgaactaaacttataattttgaaataaatcctgcctattaatggtttgtattttttaagacattaccagaattgaagaagctagcattttgtttcacacatttgtctctatatttatgattcatattggtttgtgattgttttgtgtgctaggtttgtcgaattctgttattaagattgtgctggccttgtcaaacaaagtgggaggcttcctatatgtgtttctatgctctgggaaagacataattcaataaatcccaagttactctatgacaagcactgtaaaggccaaattcacaaactgacattagggttcttgcttcatatgtcaagaaggagagcaaatggtggaaaaggatctcttaaaattagtattttttaacaaaaataggtaaaatataaaatagctggacgcagtggctcttgcctgtaatcccaccactttgggaggctgaggcaggtggattgcttgaggtcaggagttcaagaccagcctggccaatgtggcgaaaccctgtttttcctaaaaatacaaaaatcagctgggtgtggtggcaggtgcctgtaatcccagctacttaggaggctgaggcaggagaatcgcttgaacccaagaggcggaggttgcattgagccaagatggtgccagtgcactccagtctgagtgacagagtaaaattctatctcaaaaaaaacaaaaaacaaccgcataaaatatctattagatttaaaaactttttattttgagataattcaaactttgataagttgaacaaatagcacaaggaacttctatgtaccctttacccagattccctgattattaccatttactacatttgttctattatatatatactttcattttccatctgtaaatatatatatagtgtatcatcctctacatatatacttatatacttttatacacatgggcagatagtatatgataaaataatatatctataaatgtagagataaatatcgatataaatacagatacatagatttttttctgaactctgcaagtatgttacagatgattagatattcttaaagtgtatagaggttttcaaatgtcaaatgtgctaaaaatcttatttcttttcctgaaacactgaatctttaaattctatctatatcttttaatatattctatatctatctatttatgtgtctgtcagtctagctacctagtcatccaactatctattcatttatcattctatccaggtaatacaggctcatcgtagaccaaccacaaataaacagcaaaagaagcatacttcaccacccagcaataacaactttttaaatgcaaatataggtataaaattatacatatcttctaagggatcatataatacattctatttaattaatttatttacttatttatttatgacagagccttgccctgttgcccaggctggaagtgcagtagcacgatttcagctcactgcaacctctgccttttgggttcaagtgtttctcatgcctcagcctcccaagtagctgggattacacgcatgcgccaccatggccagatcatttttatatttttaatagagacagggtttcgccatgtttgccaggctagtctcaaattcctggtcacaggtgatccgcctgcctcagcctccccaagtgctgggattacaggtgtgagctaccgtactcagccggatatactataatttacttaatcaatgcctgtgttatttaggttattttttatgttttcttcattgtaagccacttggaacatgagtttagaaacatcaagagctggatttgaatcctgattccctttcatttaccctctatatcactttgggccaattactgatctcacctagttcagttttcttatctttaaaatggagataagaatatacatatcagagtatgcaaaggcatacagagtggtgtaatagaccttggactcaaaggggggagggtgggagaagggtgaggaataaaagaactacaggttgtgtacaaaatacactacttggtgacaggtacactaaaatctcagacctcaccattatccagttaacctacataaccaaaaactacttgtaccctaaaagctattgaaataaaaaatatatatattttgaaaaaaggggaaaaaaaggaatacccatatcatagggattttgtgaagattaaaggagatgatttatataaattacccagtccagttcctggcacatagcaggccttccgtaaatatttgtcctttgttcctcgctttgtttcaaagatagttctaagattcatgaagtaatgtctatcaaatgctttaagttttattctggtattatcctttgtgtaaatatcatgtgctttcaaaaatattgaatactgtcaagatatttttgctcactcttgataaaaagagagaacatcccaaaataaaacccaatactaccaatcgaaagaataccattttcttaaggctgatagaaaacacacagatacggctgtccaatttgtgaaataaaatggacttgacagacctggctgatgaaaaattgccctctactgaagtgagcaacctggctttgtgaatttttttctttaaatggcatataagactcagattccgacttgggaaataaaattacttcctattctctccaagaagtgagattttttaaaaagccgaatataatcatatgtttgtcttaagatccacattctataaaccccccaaatttgtcttcatgtgaccatgaagaagacacagcatgcattgcttatgaatgagcagatggaaatttagcaaatgagcacttatgaaacatgaggcaatgaatgagatagaacacttatgtcacacagaagacagatgactcaaggtacggccagatcatctctattacggaatagctatctttgccaatattttgtgaagaaatgcaatatattattttcaagcccagcttcagcagaacaataagatgaagtagggactctgcattaatgaacagaaagagatgattgtgattcatagaccatttatttgtaaataccttctggctgagattcaaatagttctcgtaattaaacaccaccccctccccaaataatctttttttctgtaaatgatcctagccaaatcatcttttgcagacaatggaaatctgaaaacttcagttcctataaagtcatttagtgattaggaagttcagattattgaaaacagtgaattgtcattttcctcatgttgtatgtatagtagagctttgacttcataaagttcttaattttttaaaattattttattattattttttgagatggagtttcactcttgttgcccaggctggagtacagtggcaccatctcacctcactgcaacctccacttcccaggttcaggtgattctcctgccttggcctccctagtagctgggattacaggcgcctgccaccatgcccagctaatttttgtatttttagtagagacagagtttcctcatgtcggccaggctggtcttgaactcttgacctcaggtgatccgcccacctcagcctcccaaagtgctgggattacaggtgtgagccaccgcacccggccacttcatgaagttctttgaaacaagtaatatcagactagcaaatgtggggatgcagtggggaagtgctaaggaccaagcatccattgtggtgggctttttattactagtgaaaactcagcttctgtaattttgtgtgagtctcctatgtaaactgggtgcaccccttcagagaagattcccatttttctcagatcatgctggctctttttcacgtggccacatagaaagcaacaaattgccaagttacaaatatatcaccacagtcctatatgtgcaaaggggtgctgcatgaagatttgggcctgtattgaagacttttggaatgtgagattaaataattttacttgaaaagtttgttgttattcatagttttcctgctctgatataccgtttgagtattggtaggtgtgcgtgctgcatggagtgtggggagaaggtaagaagttgtcagattagggctgggcgtggtgactcacacctgtagtcccagcactttgggaagccgaggcggttgggtcacttgagatcaggagttcaagaccagcctggccaacatggtgaaaccccatctctactaaaaacagaaaaaattagctgtgcatggtggcgggcgcctgtaatcccagctacctcagaggctgaggcaggagaattgcatgaacctgggaggcagaggttgcagtgagccaagatagcaccactgcactccagtccgggcaacagagagagactccagctcaaaaaaaaaaaaaaaaaaaaaaaaaaaaaaaaaaaaaaaaacagacctagtgctagatatgaaatattcccaacacacaaaataatgataaatgtttgaagcaatggatatcccaattacccagatttgatcattacacattgtattcttgtatcagataatcacatgtaccacataaatatgtaaactataatgtatccataatcattgaaaattggaaaactggacaaatatagaaatttttttttctgaaggctctgtggaagatgtgaatgtatctctaggatatgttctctttctaaatagctaaatgaactaaagaggccatcagagtgactactgtgtgtaaaagcttgtgttttggtagttctgacagtcagcctgtcaggttttctttttttttttgaggcggagtctcgctctgtcacccaggctagagtgcactggcacgatctcggctcaccgcaacctctgcctcccgggttcaagcaattctcctgcctcagcttcctgagtagctgggattataggcatgtgccacatgcccagctaatttttgtatttttagtagagacggtgttttgccgtgttggccaggctggtcttaaactccgatctcagttgatccacctgcctctgcctcccaaagtgctgggattacaggtgtgagccaccgctcccagacaggttttcttcttatgtgtgcttttccaccctcagtgcatgtccttgtcttactttttgactcttgtctgctctaagccttccattttaagatctgatctcttcccctattgctttaatgtagctcctctgtcattagcggtttctactacaaataagttgggtatgcttggtaagaaccagctctgttcattccattcattctaagttgtatgatattcagctggcgggaagttcaccacttcaaatagattgaaatgcacaacattttgattgtactactctgtgaaaatagtcttatttaccaagcatttacttttattcctggcactaattgctttcaatcgtaagtaacagacagcccaactcaaactggcttaaacaataaaatatgctgattcatgtaaccaaaaagcctagtaattatgtagacttcaggtaagggctgatccagcaactgaaccatgtcattaaggatcacattttttttttctttctctctctactctgacatccaccatgtcgtatttccttctaagtctgtttggtcatgagattgttgctaataaccagaatttatacttcctcattcatatctagcaagaggcattgtgttagacacaagggatacagaagtacaaagattaataaggtcccctaggctgggcggggtggctcatgcctgtaatgctagcactttgggagcctgaggtgggtggatcacctgaggtcaggagctcaagaccagcctggacaatatggtgaaaccctgtctctactaaaaatacaaaagttagtctggcgtggtggcgggagcctgtaatcccagctactgggaggttgcagtgagccgaaatcgctccactgcactccagcctgcgtgacagagcgagactctgtctcaaaataataataataataataataataataataataataataatgtcccctagactatcctcatggaaattacaatctgcatcttatgagtgttcccataggtattgtaatcaatactctagaactgtcctgctcagcatggtagccgctagccactgtggcttttgggtacctgaaaatatggctaggtggaattgaggtgtgatgtaagtgtaaaatatacaccaaattttaaatacttcattttaaaaaatgaaagcactctcattaattgatagtttcatttataatcagtaattgcatgtagaaataatattttgagttatattaaggcaaataggatataccattaaacatctcacctgtttctttttacttatttaaatttagctacaagaaaattaaaaattacgtatgtggtttgggtaatatttctaccagacagcattgctctagagccctgaacaggctattagcaaggtgaaatatctgggaataactcaaatggatttcagtgctagagaaagctcagagaacacctttatttaaaatagtcctctggctgggtgccgtggctcacggctgtaatcctagcactttgagaggtcaaggtgggcagatcacttgaagccaggagtttgagaccagcctggccaacagaataaaaaacaacaacaaaaattagccagacctggtggcatgtatctgtagtcccagctactcaggagctgaggtgggaggatcacttgagctggggaggccaaggttgcagtgagccaagactgcacaactgcacttcatccagggcaacagagcgagactcgatctcaaagaaaaaaaaaagaaagtcccctacccaatctccaatccctttgtatttgtgtcctttgtggtccttataaccatctgaaatgatgtcatttgtgtacatgcttgctgttcttctcacttacacccatccccgctcctgtagatgttaaactccatgagaaccagccccttgtccattttgggtgtcactgtgaccgcagcaccaagcatagtgcctgccataggaggtgctcagtaaatacttcctaaagaaaggaagaaaagaatgtgccctctgtggttggctgagtgcagttgtgggggcagctgactgggtagggaggagtggctttttcttctccgtttcactccatctcctcctgtgcccacagtcccagaagactcttgagatgcaactggggcttgcccctgaaaggaggggaagcaaaatcatcagtcattttccatttgtgttctgggcctcaggaaggcaggacagggacgtgggcaatgagacaggcctgggcccttctaagactccctgttggtgggatctgatgcaagttacagacaagaaaaataacttgcaggtggttcaagtttgggttctgagaaaagaaaaaaaaaaagggattctgccacttatcagctgtgtggccatgggcaaactacttctttctgagcctccgtttcttatctggtgatactgttggacaaatccaatgagatgcgtagaaagtcttctacacatggttcaataaatggaatccgttgctactgttaatttcacaaggattaatgttttaaaagcacttggcacatagtagatgcttaagaaatgttctgcagccaaataaaaataacttagaagaagaccttgacatcactattaaaataaaatattgtgatctagttttttttctcaaactccccacatgcctgtaaataaggaagctggttctgaaagaggcaaggctggagataaaaaacagcagatgaggacatttgtacgtattcccaacttgcattgccagaccttggtcatgaccctaaaccctggacggttttgataatctaattgtcagataacacattcattggaggccatgtgatttttaaatcactcccacaggaagagaaagaagaggaaaagggaattggtaaaaataagaataactatcctcttacgccgctctagagcttctctggatgccacttaaaaaaattctaccaatttcccttcttttttcggacatggagtctcactctgtcgccgaggctggagtgcagcagcacgatctcggctcactgcaacctctgcctccccgattcaaatgattctcctgcctcagcctcccgagtagctgggattacaggcgcctgccaccacgcctggctaatttttatatttttagtagagacagggtttcaacatgttggccaggctggtcttgaacacctgacctcaggttttccacctgcctcggcttcccaaagtgttgggattacaggtgtgagccagcgtgcacagccctcatttccctttgttctctcttctttcttatccctaggggatccttaacttgagtccacagtcttcccacaagagggctgtcaatacaattcaggtacttggatgggaaaaaattgcacctttgttttcactaacctctcacagaattttagcattttctttaattatgaatgtaggcaacaaaccctggtactattagcagtgcctgtgactttgttaccaacagcaatcatgattatttttctaccttattgcagatgttgcaggtatcttgaaatgttatgtacacgtatcactacttcaaaattatagtagttgtcagactcaaagttagggcttggtatttaatgaattaatcaaatagcacatatatatatttcacacagtaaaaaaagttgtgctgtgttttgaaatacctgtttttctttgtaagcctatgtttcttattttatgtacttataaacattattctcagaatggtccataggtttcaacagactgctcaagagatgtaggcagaaaaaaccattaagaaccccagtgtatgtaaggattgctagagcaagattcaagaaggcagttttatttagctccagcctcttgatccatcttaattcaggtgcttggagtggcattgactattacgtggcctcatgggtccactcatgcccaaatctttgagtacttcactgtctagactcccggggtaatgagcatgttactgacagttaatatgtgtttatgaggatattagatgaaactggagtttgtaccagtaccaacccttgaactgattaaatgcagtctttatgattgtctatgccttggaacctgtatattttcaggtgaaattactaaggcttgccatgtgcttatcatgaaagcagggcattaaaggtcaattctgggcctggcagtgtacatctgtagtcccagctactcaggaagttggagagggaagaatgcttgagcccaggaattcaaggctgtagtaagctaagattgtgccactgcactccagcctgggtgagagagcaaagccctgtctcaaaaaaaaaaaaaaaaaagtcaattcttattcgaagtgatatagcttttatgaacagtgcaaatgattggaaatagtaatacaccaagtagagtgtttatccataagcagatactacatggtgtacaacagagctagcttgttattcaatgttgaagacaggggctgttgattgaacttagaagggtggggagtaagggagtaggggaactgcaaacctggaggtgctgggagctaagtcctaagggtcagatccaatatatatagcttggctttgttggaaggaaggaatgaacagggcctttggtgagagatgacaggagataagagatgttgaaatccattggtgagatttttgacttgcagcagggaatgctaaggtttctgagaagtggagcaatagcctgcaaaatgctatgcatgggaatattggctgaaaaaaatgaatgggaaagcagacaagggggcatttttgtagcataaatattgccacacattatgaaaagtttcctgtgagttagcttgaatgttgtaggaggaaagaaacatttcactttagaagattgtgggctaaatttaggttcctttgactaaatataagttcctcagcatgactaataacacaggatatgtgcatcctgagaaagacgtatacacccacaatgacacttttccacctgcccacacccaggtcctgttttacaaggttggtatgtttaagtgtattttactttgcagttgttcagaaggattgcatatttttgaaaaactacttcctgaaagaggatgactgtttggaaaggaaagaaaaatcctagctggctttggtggtaacagttgggaggcatacccacgtgagctttggtggtaacaattcctgaagcttctccaagggtccacgtgttcctgctgttggttgccagaagccagaataataatggagctgagaatatgggatttttgtgagaaattccaggggcattcagatttcacagcagaagcagatgactcagatgtcctgcgccttagagagatgcgtgaatcccttacctttaccatactctgaattggtcaacggcagaatggaagccctacaaaaattgaaaagttggttgcatgctaacattcatagtggaactgagttgaaaattttatccttgtatttccagactctctgattagattgttttagctatgctctcacccccaattctgagaacttttcaactgtgactgaggtgtggatgggtcaagcatctttacaatgtgacaaaatccccatttctcctctgatttactactaatggggagataattcattactgtgaagtgagcctttaatagattaaaaaagttgtaagaatatgtcacatagggcaggacctaacagggctgggcactttattgaggtgaccttatttaataatatcattagttatcatttattggactctgaactgagctcccaacacggaagatgtaagatttatctgcattttacagatgagaagacagaggcaccaagcagtataactagcccaaggtcacacggctgatatgcaatggagccaggattagatttgggccatttgacctttactgcctggtaaaagccctgaaaactaggaaggtgatattattcctgttttacgattgggcaaactgtggcttagagaggtgtattagtctgttttcacactgctataaagaaatacctgtgactgggtaacttgtaaaggaaagaggtttaattgactcacagttctgcatggctagggaggcctcaggaaactgaaaatcatggcggaaggggaaggaggcatgtcttacatggcagcaggtgagagagagtgagcaagagcagggcaaactgccttataaaaccatcaaatctcttgagaactcattcactatcacgagaacagcatgggggaagaatgcccccatgatctaatcacctcccatgacgttcttccctcaacacgtggggattatggggattacaatttgagaattctgccactgaaccacccatgcggggattagaatttgagatgagatttgggtggagacagagccaaaccataacaacaggttaagtaatttacccatattcacacaattagagacctataaagataccttccagagtagtattgtccgatagaaatataatgtgagtcacaaatgcaagtcacatgtgattttatgttttctaggagccacactttaaaaagtaaacgtgtcagcagttgggatgatatattttatctaccccaatatatccaaaatactgttatttctacatgtaatcaatgtagaaaacttacccatgaggcattttctcttttttctttcttactaagtctttcaaatgtggtgcatatcttaaacttgcaacccttctccatttggaccagccacattgcaatacccagtagcctcgtgggactactgaaaagtacaattctagagtggtggttctcaacccttgctgtgcagtggaattactagggagcttataaaacacagatgcctgaggcccattctcagagattctcatggaattgatctggggtgctgcttgggtgttaggatttttgtttgtttgtttgcttgttttttgagacagagtcttgctctgttgcccaggctgtagtgcagtggtgtgatctcggctcactgcaacctctgcctcccaggttcaagcgattctcgtccctcaacctcccgagtagctgggattacaggtgtgtgccaccatgcctggctaatttttgtatttttagtaaagacggggtttcaccatgttggacaggctggtctcgaacccctgacctcaagtgatccgcctaccttggcctcctaaagtgctgggattacaggcgtgagccactgcacctggctagatgtgaggatttttaacgacctccctcccgaccaggcagtgcccaaactaactgagtagaaaactgtagcctttgtacattagagaagtttctgtgagttttctgagatgagaaccattcagaatgactgctctggcagtatgctttgctagttgacattaatgaatgccaagcaatgcccaactaatttattaatttctctccatttacatttcccaacatgttgaccaagtctccagaataatataagaaaagagattttctttctcttgctgatttacacattggtctggatacataccagtgaaagtaaattcagacataaaattctactcttttaattgaggtcaaaggtgttggtgtcagcctggaatctctgagctgtggagaagaggaagttggggtttgaaagctgcaggtggctgccagaatgagacaagtctagtggggaatgcgtgggaggtgctgggtgaagaaaggaggcaattgtgtttcgcctgaggtctgaaggctgcatagcccgctgtgtctcaggacgttcacaaagctgccctcaccagaagcgtcgcgtccaccttcccactggaccaaatttttgattctgcccctgaaccctggatatgaaacccaatactgaagaattaaaatgtctcatctcacccggaggttcagttgtccttaaaatgcttttggattcatttggaataatttctatattggcttctttcatttaaatccaaatatagcttcagtatttctgacatatttattactttccagaatggaaatactagttcttctgaagtggtagctatttagttatagtcaattttgttagttatgtttatttgacttcaaattaagccagagaatatgcaaacactgcagtgtcttccacagccttaccaaaatgaataccatatttcatcaaatcaaaaatattgtcaactgtaagatgcaccattgtttcacatgagctaagaaagagtaagctattacatgacgcttttttatcacttggaattttattttgtgttcattgaagttcttttagcctgacttagacataactgtttaaaaatattttaacttttattataggtttaggggtacctatgcaggtttgttacgtaggtaaacttgtgacttgggggtttggtgtacagattatttagtcactagacactaagcatagtacctgatgtttgttttttttctgaacctctcccctcttcccaccctccaccctcaagtaggccccagtatctgttgttcccctctttctgtccatgtgttctctcattatttagctcgcatttataagtgagagcatgcagtatttggttttctgttcctgcattagtttgttgagaataatggcctccagctccatctatgttcctgcaaaggatgatctcattcttttttatggctgcatagtattccgtggtatgtgtaccacgttttctttatgtagttccagaaagttctcaggcgatgcccatgctgctggtttggggaccacacattcaatagctaggctttagtgtgtctaaggacatagtatgtcactgaagaaattcagtacctctccagggtacatggatgttttaatttttcttccatttgtattattattttgatgaaaatgtatatattgcaaatttgtttgccttgcattgggtaaatgcaaaggaagaaagcaggaattttgtatgtctgatcttatggtacagggagagagatttttttccccttaatttgtttcatgaaagatttgttcatttccttttcctttgctttctttatccaacttgggaaacttgaatttattaggaaatctgcatgtaattgcagattaataacctacccattaataccacattagttcatcatgattaatagcatctatgtgaatacttaatgaatttgtaatgatggactatttgctttaaagcgtcaagagaacattccatgtaaaaaggcactacccgtaacaggaaaattaattatatgctggttggataatagcttgtcacaaagaagatatgtttgtttggaaagcctcattggtattgatatttgcagtgagaggtactttttttaaaacattcatgaaccttttaatttgtaaaatgagaaggaaattttattttcatgaacagttaaaataggtgtagggactgatatttatgaaagagagcagcacaaacacaaatatgtgctaatatactcataagtttacctatgtcactaggcagaaagacttcctatagtggccatttagattaagttccgaattgaactgcttctactacccactggtctatcctaaattcacaagttcacttctttaaggctcaagcattttttttttcttttgagacagagtcttgctctttcaccaggctggagtgctgtggcatgatctcggctcactgcaagctccgactccctggttcaagcgattctcctgcctcagcctcccaagtagctgggattacaggcatgtgccaccacgcccagataatttttgtatttttagtagagatggggtttcactatgttggccaggatggtcttgaactcctgacctcgtgatccgcctgcctcggcctcccaaattgctgggattacagacgtgagccaccgcgcccggccggcccaagcatttcttgatactcattttatttcttcagagaatcatttgttttctctactgtcttcactctaattctgtgatgtcagcagtcatcattgtttatttctgtctttgccctatatctgaggaagtgaaggtcaagaagattatgtgacttgcccaaaccaatccagccatataatttgttcgccacagattatgggtctctcatttcaaatgtctccagttttaaccccggcggaaagagttgcaagcgcagagactctgtccagctggtgcctttgaggaaacccaagaagcccagtgtgattggagctctgagttggaagggaagaggcataaatgataaaactgaggagaaaggcgggggccagagcatacaggctttgtaggccgtgtaaagattttagactctatcctagggcaatgggaaggcgtttgtaaatgtcatgttgagggatgtaatgagcgatatgttttgccagagcttgctgctgtctgtggagagtggcttggaggaggtagctgacaaatggcgaccaattcatgctttacaggccccatcatgttgatctattttctagtctggtatccaaacgaaggtggagtttgacttccttgttacagaaaataccaaggcatgattgtttatccttttctctattttctccttaggtcaacatgaaagatcattgcttcttctttgttgcccttgatttctttgaacttaggaaggtattttgtcaagcacccccactcatggggcaaaatctgccagggaagtcatggcagctactggtgggcatggtagttagtactcgttctaccagcacttttgcccctttgggttcactgcttgtgccaaaggtgctgttgcttccccccttttgggggagaggattctggatagagaaggaaagaaagccttacccctaatcactcactgtcggaaacccagttctggaggagcagtctccctcgaccacacattgtggtttgaacagccaggaatagaacccctccttctctcacctcctcatagaaggtgggagtgaaaacaggggttagttgggaagtggctttttaaacctatgtttacagtgttttgatgtcactttcatagacgagggaggaattgtctgaagctcagattttttaggatttcagggatgtgatgtttatctctctcttcctctcttgaggatgtggtataaactggaattgaaaatagatacccggctgggcgtggtggctcatgcatgtaatcccaacacgttgggaggttgaggtgggtggattgcttgagcccaggagttcaagaccagcctgggcagtatggcgaaacctcatctctactaaaaataaaaattaaccaggcactgaggcacatgcctgtggtcccagctactcagaaggctaaggcaggagaattgcttgagcccaagaggcggaagttgcagtgagccaagatcgcgccactgcactccagcccaggcaacagagtgaggccctgtctcgaaaaaaaaaaaaagaaagaaataccctgtatggtattctttctttcactttgagagtctttctggcatagtgctaatatttttttccactcttgaatctgtgaatcaaccctcacatcaaacccctattgcattttatgtttaagaagggaactttttaaagctgaggttggcagaactgagaaacttagacctaaatgggcctatgcaaggagggtgtttccaaaacaaaacaaagtgtttagtgtcctccttgaagaatgttgacactgagttaaaatggagctgcagagtgaggaaatcagtaaagacaggacaaaagttccttttttgatttgaggtagggtaggaaaggcagaggtgggattctgggctggtgatgtttccagggattgcaggcatcaagaaagaccggtgagtgctgttggtttaaagtagttgttctcaaagtgtattcccccgatctgcagcatcaacattacctggcagtttgttagtaatgcaaaatcctgggtcccaccccagacctactgaattagacactcaagttaaaacacagccatttgtgttttaacaagctcccattttttttttttttttaaatttttgagacggagtttcactcttgttgcctaggctggagtgcaatggcacggtcttggctcactgcaacctcaaccttccaggttcaagtgattctcctgactcagcctcccgagtagctaggattacaggcatccaccaccatgcccagctaattttttttttgtaattttagtagagatggggttttaccatgttggccaggctggtctcgaactcctgacctcaggtgatccgcctgcctctacctcccacagtgccgagattacaggcgtgagccaccgcgcctggcctaacaagctctctttattattccaatgttcactcaagtttagaaaccactggcttagactagagcaaaatgtgaggtcaagccttgaggaccagccaactttgttctgttctaacctcaccaggcctcctacctctggttaggtgccccaggagtctgtgtccctggtcaaaaatagggtgacagggcaaagggagtagatggctcatcacaaagacattgcaccactgcaaaaagaagttatgatgtaaccagggaaggtctttccttcagttatggtggagagatctgtcagggaattccatgagggcatagctgcctctcatttagccactgggggcccattctctcacaggaaagcaacttgcagaatttttctgggtatctgatgtttgaattaacaggagtcagagacctgagtccaaatcctagctctaacctttactaactgagtctccttggacaagttcttatagttttcttgcctgcacaatggagttatgatatatgtttcttaggattgctgggcaggttaattgaggttatgtattaatacaatacatctggcacagagcaggtgcttaaaaaatgaacactgtcgttactggtccttggatgtcttaggattgttcaggaacgaccattgcagggagtatataaacatacacggctttttccttgtaacgttaagatggataaaataggaggcagaggccaggtgtgctggctcacatctgtaaccccagcactttgggaggccgaggcaggcagatcacttgaggtcaggagtttgagaccagcctggccaatgtggtgaaaccccgactctactaaaaacatacaaaaaaattagctgggcgtggtagcacgtgcctgtaatcccagctattcatgagggtgaggcaaagaatcgcttgaacccgggaggcagaggttgcagtgagctgagatcatgccactgcactccagcctgggtgacagagtgagactgtctcaaataggagggagaaaaaatataaataattagagttagtagtaaaaatgctatacgaaaaaactgaggatagatttattttaaacctcaagtttggcacagaccttacatggaattatctgctaagatacaaaatatctaaataggaaagctatttatattgagttaaaacataagattggcagattcattgtaatgctatgctatcaaagaataatgctaaaattgaaattattttgaagtataaccttgataataagtataattcttataaattcacttataagtgaacataataaaagagttatcttctgttagagttttgtagtatctggcaattttatataattaatttcattatggacaaggaggtcttttgtgttaacagggacatttttgtgttatttggtaacccatgatttagaatgatttagaggattttaatccccttaaaatcatctctgcacctttttcttaagctgatgctaaccaacaattatcatttataagatcataaaaaatgaacagagaaaataattctgacagcttctatccctatatttaggtgggagttttctagaggaatgagaaagatcagctcctattggcttttcagtatgtcatacagattcagttaatcccatgcttgactggccgtgaggctgaggaactgccaagctgagtgtcacacaattcgtgtgaaaatatatgagagttacgggatccacggaccatgacttagttaacttgaattttattttttaatgagaataacaataagctttgcaagcttatttagagtctgcagctttaagtgcataagggtttaatacctttaatacccatgcagtgtgagttagaaaaatgaaaattttcagtatagtaaataaactgaggagcctggaaaccaaattgaaatctgtagcctagaaaatcaacaagagctaaaaatagtaggattagaggcagcattcaaccatagaccatccaaaggtagtttttaagtaccaccaaaggagaaagcaggccattctataataagttttaaaaaaaatctaggtctagagaacattctgttcattatgtagatgtggaagcttaaagtatagatttggttttccagagttttaatttttcatgttctttttttcaccagaatcagagggcactccctctgatttccaaaagagaaatgttaccacaatctgcatgaaattgagaatttaccttgctgacactgacgtgaagattttagaatgcagttgctggccaggtgtagtggctcatgcctgtaatcccagcactatgggaggctgagttaggaggatcacttgagactaggaattgaagaccagcctgggcaatatagcgagaccccatctctacaaaaataaaaataaaacaattagccacggtgtggtggtgtgcacctgtagtcctagctacttgggaggctgaggtgagaggatggcttgggcccaggaggttgaggattcagtgagctgtgattatgcctctgttctccagtctgggtgacagcacaagaccctgtctctaaaagtacccattaagcaaatcaagcaagtggctccaggattcactggtctcttagcaaagagccagaggccccctttcagaataggcacatggaaatattgcagggtcaggagaaagaacccaaaggagggtgtttttaagtgttcctgtgctcctgagccacttcattcaaatgtcagctcaatcaaggttcttggtaggtttttgctcataggcctaaaactttgcatgtgtggagtttttgaaaaatgttttaggtggatatgtcttagatattgtagaaactttaaatgattggcctgagctgcagatggctgttatgaactcttgactaagcatggtactgtaaaatcctcaagggcctcatccttcctttggaatttcctttttgtattctagagcactcaataaatgtcctgtctgagcagcagaattgaattgagtgaggattgatagtcctctctcagcttccgagcagaactaagtattttttttctccccagtgtagaagagcagggcattgggaatggatgataaagctgagacaattgatgaaaataaaacttaggtacccttaaaactggcgttcatgaaaacagatgaatgaagtcttggatttcattgtatgatatagggactgagatgtgaaaaaaagagatggtgttgttagtatgatcagggcattgctgattgtaaaaagaaataataaaagtagtcagtccagcttctcatagttctttttcaattggatgaaagtctctctcagactttccttgtcaggaattcaactcagcgaacattcactaagcaccagccatgccaagctctgggtcctgggtgttcaaagatgaatgtgacccagcccctgcccaaaagagtattcaatctaatggagcatagccattgttaatgccaatgttttataccaaaagtatttcttggtgatattatttgaggcccaatgaccaaaaatatctttattattaaaattctcacgtttcatcccctttgaggctaggcttgggttacaaaggcatggttgtccacaccatggtcaaaaacaaattttagatggactgtagatctaaatgtgaaacaataaagattttagaagaaaatgtaaactgtcaccgggcgcggtggctcatgcctgtaatcccagcactttgggaggccgaggcgggtggatcacctgaggtcaggagttcgagatcagcctgaccaacatggtgaaaccccgtctctactaaaaatacaggctgggcgcggtggctcatgcctgtaatcccagcactttgggaggctgaggcgggtggatcacctgaagtcaggagttcgagaccagcctggctaacatggtgaaaccccacctctactaataatacaaaaagttagctgggcatggtggcgcatgcctgtagtctcagctacttgtgaggatgagtcaggagaatcgcttgaacctgggaggcggaggttgcagtgagctgagatcctgccactgcactccagcctggcgacagagcgagactccatctcaaaacaaacaaacacacaaaaacaaaaaacaaaaaatagctgggcatggtgacatgtgtctgtaatcccagctacttgagaggctgaggtaggagaatcgcgtgaacctgggaggtggagattgccgtgagccgagatcaagccactgcactccagcctgggcggtagagcaagactccatctcaaaaaaaaagaaaaataaaataaaatgtagactatcttcatgagtttgggataggcagagatttcttgaacgggacactaaatatggtaaccatggaggagaaaaatggagaagctgaactaaaataatttcagtttattacaagataccattaaaaatgaagtctatgtaatgggatattttataatatattcaaaaaggactcgtacgtagaatatagaaagcacttctacaaatcaataacaaaaaggtagattgctctataaatatgtgatatagacttgaataagtattttaccatagaggatgttaattttcttgcttggggttagtgattggaagggagcacaaggggcttttggggttccagtaataatgctggttacttgagcgtgttaactttgtgaacattcttcacattatgatctgtgtacttttctgtatgttgtattatttgtgtacttttctgtactttcattggaaaaatttacataaaaaaagaaaatgctttgctgtccaggatgaagaatgtgagcagaatatttttggaggttaacactgattgcaaaatatgtcttcccatttagaattgcctctactatagaagcagaggaaatgttgagagcatggggctttgcaaggtggctatagcaggtgcagtttgtgaaatagtcctacacacagcctggcagtgtcttaggttagcataagtcctttggccaacaatatcctgagaagcaagcaggagaacaaacacagttatggaggaagcactagaaacaagcttgattacttgacagttttgtatagggcgaattctgcctgtaatcctgtttaagtcaccacttactgatccccgttatcatgtgcccaggcaccaagatgggggctttctgtgtattaaaaattttaaatcctcagcacaatcctgggaagcatgtactattattatttgactttacagataaagaaactggggcttagagggattaaataactcgctcgaattccagctagcaagttgcagcaagctgcaactggaacccatgtctgtgtgattccaaagcacccccttcccacatgtctattatgttgcctttaaaaaaaagttatttgatggagcatagtgagaagaaaaatacttaatatgtacttaatgttcaaatttgatgatcagaagaacttctcaaaccacttttaaagtctgaggtttgctgtgctatagtttttttttttttttttttttttttttggaaacacactttgtcgcccacgctggagtgtagtggcgagatcttggctcactgcaacctctgcctcctgggttcaagcgattctcctgcctcagcctcccgagtagctgggactacaggtgtgcgccaccatacccggctaatttttgtattattagtagaggtggggtttcaccacattggccaggctggtctcaaactcctgaccttgtgatctgcccgcctcggcctcccaaagtgctgggattgcaggcatgagccaccgcgcctggcctgcagttttatgaactgctattgtcctttgcagttgtaaggtggtaagaaatacctgggtggggtggaggtggggattgagaaatcctccaagaaacaacacaggctatgattggaatgcccctgtatgggtgacccatgagcctttctcaatgctttggggacattttaataacctgagtaattacctgtggtacgcaggctttgttttctactcattaataactctccaggctacattttattcttcttactgctaattcacatgcagagatacataaaatggatgctgtcaactgattgccacatcactgtctgcatatcaatgctctcctgtctgcttgggctcagagagaaggaaagaagagaaggaaaagggtatggcaaggaacttgtgatagccgaatctgttttaaaagccaaattctggtacagaaaccagaattttgacatatacaaattattgatatttgtgcatggttagtgttttgggattgccctatttagcatctgctgatcctctttttccctccctgtgatagatagcatgccttggaagcagacacaggtaaatatttaatgcttttagttttttttgctcctgtggcttgtttggcccttagggcattcatgttttttagcctgtggagtgcttatagcatcagaacatcatcacaaccctaaatgaaatttggattatttacttctaagtatgtttcccaaatagtctaatgactgtgtaagcaatatagtggaagggtacaggagccgatttgaatggaaatatatgtggatatggctttagatctttctgcgtattaaaaaaaaatctcctttaaaaaatccttggggacctggcacggtggcagtggctcatgcctgtaatcccagcactttgggaggccaaggcaggtggatcacctgaggtcaggcgtttgagaccagcctggccgacatggtgaaactccatctctactaaaaatacaaaaaattagccgagtgtggtggtgtgcacctgtaatctcagctactcgggaggctgagacaggagaattgcttgaacacgggaggcagaggctgcagtgagctgagatcctgccactgcactccagcttgggtgacagagtgatactctgtttcaaaaaaaaaaaaaaatccttggggctagttatcttgattttattattatgatgatacacaagaaagaaaacaccaaacaagctgaaataattgaaaatactcacatccaacccaatttaatttatttcactggaatctatctagttatatggacttgttttaggtacaggtacttatttttaaaaaactagacaggagctctgggttgctttttttttttttttttttttgaactgtagaacttctggtttagaagtaagattcctcttcaggagatatacaattatttattaacttaattagtgccgtacattttgtcttgaagctattcagagtattataggaacatctgttgtactgtgattatgatggctgctaggctgtttccccaaatgccttgacaaggcagtttgacatagttcggtgaaggcagtgccctggtgctgcagtcaccatagggatttttcatcttggcttcatgttggtagattgatactctcaagtacgttcaaggttctctttttcgggagagggttgttttcattgagtcctggctttcctctttccttatttaatgaaatagtgacaactatcattttctaccttcaaacattattattagtgattttataaatagaaaattattttccaggtgggcctatgtctgtgctggcaaccattgtgtacacacggactctcttagatgtttaggactttgcatgtgtaaacgggcaagttttcaggcaattcgggtaggttttccaatcttgtctttccatttcctgtctaaagaacttcttccatgtccacagcatgtttattcaacaatggataaaacttctaatgggaaatttcttccgggtgacctccttgagaggctgggctgtggagaaatcttaagaaacacaaccctgatgaaattggctccgttgagaatattacttggtccaggaacaagggacagaattcagttatttttggttcttgaataaatgaattctgtttccttttgtgtaggtggcagaagaaattaacccctgtagaacatccattctcagttggaaattaaatttttggtttcttttgagttaggagtaccctggataagagaatgtaaaactgtttttatttgaacctcatgcaacttggaatctgttctgttgtctgcatatctttgatagatttgtcttttccagggttgtctgtctttgtatttaattttctggaggttggaattgtgattatcaaatgacttccaacttggcaccatatgtgggtggatactaatgaatcctttcttaaccttcccagaacttttggagaaatcaatcagtagaaggcgggacaccgaagccatacagaaagccaaaatcctttattcatcctgcatgaatgagagtgagtgatgaagaaaactaaataaaatatttaccatccctatcctttagagttctattaatgttttaatatattgtttgaggaagaagagaactactaagaattctattaatgtttaaaggtgttaaaggaatgattgtgaaagactggattttgactagtcccatcttagttaatgttgttactggcttggtggagaaaatcttatttatatgagttggattctttgggtatcatttactccctgagaaacttagacaaagtcagcagggcaaactccactgtatctggtagagaatccagaagccaggccaagtctggcttgagacagagactgggagggagtgcacctactggagcctagagaaatccagattcccaggcatgccaggttcctgtgtcagcctaacaggcatctttgttgggtccttagccctgtctcaatatcttgggtctgattggaatcagaacagatactggccacttgacctggtctgccttctcaagcccaccacaggaagaagccagtgcctgtgggaagtgtgtcaactggtctaggatttggggtatcatgtggtgagctagaaaagagcaataaaagacaggaatctgaagcatcacttcttcttcattgggtagtgattggctttattgaggcattcctttagttagggttgtaacttagtcccaccaagtattattcattggctgggttccatgtagagaatccatgtttattgtagtgaatatccagcagtttccctggtcagctctcctggcaagaacactaggtatagacagtcacattgaagcgtggatcgtaggtagttctgtctctgtgattatgctcatcccaccccacctcttttacctactccctaacagctgaaattttaagttggagcattatgggaattttgtcttgagaagatgcacttaaattctagtgtgctgatccagtttgcaattctaactttctcttcatatctgctccctttcagaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaaggtataatgaggacccattcatcttctttgctcagtcctagattagccttttggggtgccatcctggggaaagagactcatgctgccttagtgaaataataacataaaacacttttattgaatagtagaatccagaatattcccttctcccggctttgcagaatgtagaccattaccatacaagttttgtaagccttttggaaaactagtgaattagtttcaagtgatctgtgatctggccctcatatgcctactcagagcaagcctagggttcctaaattccagtgggaaggggactgcaggtctcctgttgttagcagagattttctgagccctgctcttgtccttgcctcctcactcccttgatagaggagaaaacacgtgccatgattttttgttcctctttcactaacattttcttgtgcacacacctaaattttagttatcaacttcactctgaatctctcctccctcctttccaaagatacagcaaaacttgttctgttccaagtgcttggttgcgttttctgttggaagactaaccatgtctcccataaagcaatgggccacatggacataccctgaggcatttcacactggtaaaatcaggaggctgtcagaaaactaccaacagctaaagactcaccaatgaaagagctatgcaagaattcaaataacattcgtcaaatagttttgtgctttgatcctgctgggttttgttttgttttgcttccacagttactttgactaataatgaaaatgttattgcatgactgattttctccccaattctgtccttagtcaaatcagaaaatattaatgaaatattgatattcaaattgtagacatgtattgccctcacctcatgcattttaaccttctaaaatccaaatcttaaagttcatcgtttgattgaagctggtcatcgtttgatcagagattggcacattttttgggtaaagggccagataatacatattttagggtttgcaggccgtctggtctctgttgcaactacttaattctgccattgtgtctgggaaagcaactgcagacaacaaaggtatggctgtatggcgggctggcccagtggctgtagttttctcacctctaggttagacaatggaattctcagtaaaaatctttggtcattgaaaggactcccctctactcaggaggaaattctgagttccagagacaactgtgtttctatgtttggtgatgaaatgagccatcttctaatgctatcaggataagatgtgctatgtaagacacaatgatgatgacgacccaactgatctctgtactgtgttgatatatcactcattttttgaaactaggttttaagactatcattatcagttccagaactattatgatgttctttcaaacaccttaagttggtgttttgaagtaagctgaaggctgttttccaaacttaagtttaagtttatacattctattgagtgatagaagatcttgattcacacacagatgaataattgcaaacggtagccattttattatctttctcacctatttctggatctattcaattgaatttattgctttaaactttttattattaaaatgtggtacaaaattaaagaatagaaaaataaactcccatgtatccatcaacccagcttcaacaactctcaaccttctgatgttatgtttctttctgcagttatgttttaatctagagccctccttttttgggaggtggctagaacattttatagcaaattaaaaatatatcattgcatagtaaatacttcagtgcttagctagtggaaaggactattatcacaaccaaaaagataatcataattccataattaacatctaataactagttaattttcaatttttctgattgtcttaaacatgtccttaaaaaaaaaaacagttggtctttgattcaatctccaaataaaaatcacaggtgaacttagttgatatgtctgttttactccacaagggatccccctatttttgttttttaaaccacatttatttgttgaagaaactggagtatttgtcctgtaaactgtcttacattctgaatttgactgttttcagggtaatctaatagctgatgaaagttcttgtttataggagaatcacagcttaaaaatgcagaagaaataataggaagctatctatttaaaaaaaaatccctaaggaaaggattgatctaggcaattatcatcaatggctgctaaaaccattaggtaaatggttgattgggaaattcatgatatcagaccgatatcacctgaaccctaatatcaatgatagcattgctaaaagtggggcaaccagatattgtgtgcctcctggtatcagtaggaagtgcacactatcaccagtgatgttgtcgtgcccccacaattgagcctctagttttaagaggagcttacagaaaacatggggaatagagaaacatggtaaccaatttttaatagcttgccttgtatacttaatattcaattaaactgatcctagaaacactaaaatgtcaatgatagaatactttccaaatgtaaggaggcacccatgtacttattattgctctcttttgtcaagatggcagcttgttccaaactggtgtttgaacattgtttggcatttgagtgcggcaaacgtttgcttaagttctgttcctgtttgtacctttttccatgactgaatattcacacatctgaactaattgccttccctcagatataatataattatagtcttcctgatgacacatttacaagagttcgagcatgtatctggaggtggtaggagaagttttattctgagagctgcatgaaacccattgaacctgataacaaaaattagcgtactggtggctgccaaagttgtagaatttgcaagtgttgcttttttattcatttaaaaatagttaaaactataaaagacaaaatctaattggatgaacatttgaagccccccccacttataggttttgtggaacatagtttgaaaactactggtatagttaaaaaacaaacaaaaaaaataataggctttggtatttaaaagattgaggtttgcagtttagctttgtgatgtactcaccgaatatcctcgtgcaaattacttcacctcgctgatttcacttttcccatgtgtacggaagggtgaattagaatttacttttaatcgtcattgacgttcaaatgaattgacttttgtgacagttttcactgtagatactggtccacagtagcacacgacacaaggttccgaacctactcttcaagcatgacccagcaactggtcaggaccatttggagaatgtttttctttgacatgtggtacccgatatgcctctcagagctcaaactcagtagtgcaaggaataggaattttgtttactcaacctaatatttgacttttagctcccacccaaccttttggtgggaaactgaaccttagtctaggcatttacctcccctcttggtggccccatttctcggtcttttcctagggtattgggaaactgcaataaccagttatctggtttctgagaagaaacccactatggaaccatgtagcctcttcaagtgtgcccctctgatgctgaggtcctgcgactcccattccttctcagatcctgccatgttttggggtgatcagttcctctgctcatgagaattcttgacttcttttgctgcttgaaagatcctctttctgctctgggagaaatccctcttacctgaaactctcttccctcaatgtcgttaggcttccttttccatcgaattcaattttcttcggtgtgcttagcttttctaatcccacaaacccacaggaataagagaagggccttttgggcaggcacagcactgtgggcatccttttgggtgagcagatggtgcctttgggtgaagagacaggcaccctttctaagggttagatatatccccatgccaaagacatgcagtttggccagcaggggtcgctctaatctacacagcgtacttctgcaaagctcccctgtggcaaaatgatacagggtttgctacaggcttaaatgaggtaaaggaattccaaaaataaagaaaacaacagaagttagtgaccaaaaacattatcttgctgcacacgtttggatttattctatgtcaggagatagtatgaggatttaagggacaataaaagacgtgagtatatgtgatcctgaaagagtatttggaaggccaaggatgtcccagtatgtattactagttaatgaagacaacaacttaaagtcatcatctcacaacagcctgcatttttctggctctcagcaaaactcgtaaaaaatggcaaggagaaactccaagaaaatttgaaaagtttcattctctttccttttcctttttttctcaggaactgacagaacatagaattttattttattattgttattttttattgatacgtaactacacattttcatggtacatgtgataatctgatacattcatataatcaaatcatggtaactgggatatatccaataatgggattgctgggtcaaatggtagttctgttttaagttttttcagaaatcaccaaactgctttccacagtggctggactaatttacattcccaccagcagtgtataagagtttctttttccttatatccatgccaacatctattatttattgactttttgataataaccattctgactggtgtgagatggtatctcattgtggctttgattcacatttctctaccgattagtgatggtgagctttttttcatatgcttgttggtcacacgtatgtcttcttttgaaaagtgtctgtttatgtcctttgtctactttttaatggggttgtttggtttttgcttataaatttgtttatgttccttgtaaattctggatattagacctttgtcggatgcacagtttccaaatactttctgccgttctgtgggttgtctgtttattctgttgatagcttcttttgctgtgcagaagctctttggtttaattaagtcccgtttgtcattttttgtttttgttgcaattgttttgggcatcttcatcatggaatcttgcccaaagtaatttacagattcaatgctatttctatcaaactaccaatgacattgttcacagaattagaaaaaggctattctaaaattcatatggaatcaaaacagagcccgaatagccaaagcaatcctaagcaaaaagaacaaagctggaggcatcacattacccgatttcaaactatagtataaggctgtagtaacaaaaacagtgtggccggtacaactacggatacatagatcaatggaagcagcccagaaataaagctgcacaccaacaaccatctgatctttgataaagtctacaaaaacaagcaatgggtaaaggactgtggtgctgggataactggctagccatatgcagaagattgaaactggacccatcccttttatcatatacaaaaatcaactcaagatggattaaagatgtaaatgtaaaacctaaaactgtgaaaacccttgaagaaaacctaggaaataccattccagacataggccctgtactatattttgaagtcaggtaatgtgattctccagctttgttatttttgcccaggatcgctttggctatttggggtctttcgtggttccatataaaatttaggatttgttttttctattttgtgaggaatgtcaatggtattttgatagaggttgtgttgaatctgtaaattgctttcagtggtattgtcattttaacaatattctactaattcataagcatggagtatccttccatttttttgtgtccttttcaacttctttcatcaacattttatagttttctttacatgaatcttttatttcatgggttaaattgattcctaggtgttttatattgtaaatgatattgtttattgatttctttttcagattatttgcttttggtgtatacaatgctgttgattttgtatactcgaactttactacatttgttgatcagttctaatagttttttggtagagcctttaggtttatccaaatataagatcatgttatctctgtacaaggctaatttgacttcttcctttccagtttggatgccctttatttatttctcttgcctaattgctctggccaggacttctagtattgcgctgaataaaagaggacaaaacaggcatccttgtcttgttctacatcttaaaagaaaggcttttaatttttcaccattcggtatgatgttggttatgtgtttgtcagatatggcttttactttttgaggtgtgttccttctgtacccagtttgttgagggtttttgtcataaagggatgttgaattttattgaatgcttttacagaatgtattagaatgattatgtgatttttgttcctggttctgttaatgtgatgtgtttatatttatgtacttgaatttggattttccatttaatttattttttttgagatgggatctcactatgctgcccaggctggacttgggttcaagtgatcatctagcctcagcctcctgagtagctggtactacaggtgcatgccactgcacccagcatatcatgtctattgatttgtgtatgttgaactatcctggcatccctggattaatcccactcaatcatagtgaatgatctttttcatgtattgttgaattaggttagctagtattttgttgataatttttgcatctatgttcctaagtcatattggctggtagttttcttttctccttgtgtccttgtgcagttttggtatcggggtaatgctggactcatagaatgagtttggaagtattcccttctcttcagtttttttttttttttttttggaagagtttgaatataatttgtattgcttctttaaatgttttgtagaatttggtagtgaagacatcaagtcctgggcttttctttgatgggagaccttttattatggcttcaatcttgctactaggtattagtttgttgaggttttctacttcttcatggttcaatgttggtaggttgcatatgtccaggaatttattcatttcttctagatgttccactttgttggcatatagctgttcataatagtctttataattctttgtatttctgtggtctcagttgtgtcttctttttcatttctgattttatttatttgtgtcttctctcttttattgttagtctagctaaagatttgttgattttcaaaaaaaaagccaacttttttcattaattttttttggtgtttttatagtctacatttcatttatttctattttaatctttattatctctgtctactaatttggggtttggtttgttcttatttttctagttccttgagttgtatcattagattgtttatgaattgttatttgaagtctttcaacctttttgatgtaggcttttattgctataaaattccttttcagtactcctttggctgtgtttcatagattttaatatgttgtaatttcattttcatttgtttaaagaaatttttaaatttcatttttatttttttcattgacccattggtcattcaggagcatattgtttaatttccacgtgtttggccaggcatggtggctcatgcctgtaatcccagcactatgggaggtcgaggcaggtggatcacctgaggtcaggggtttgagaccagcctgaccaacatggtgaaactctgtctctactaaaaatacaaaaattagccaggcatggtgtcgggtacctgtaatcccacctactcgggaggctgaggtgggagaattgcttgaacctgggaggtggaggttgcagtgagctgagatcatgccactgcactccagcctgggcaacaaagcgagactccatctcaaaaaaaaaaaaaaaaagattccatgtgtttgtgtattttccaagtttcctcttattattgatttttagttccattgtggtcagaaaagataactgatatgatttctgcttctttgaatttgtggagacttactttgtggcttaaaatatgatctatcctggagaatgttccacatggtgataaaaagaatatgtattctgcagcaattgggtgaaatgttctgtaaatgtcagttaggcctatttggcttagtgtctagtttaacgctgatgtttctttgttgattgtctagatgatctatccattagagtggagtgttgaagttccctatcattactgtattgcagtctccctctccctttagatctgttaatatttgctttatatacttaggtgctccagtgttgggtgcataggtatttataattgagataggcagtatattgctatatctccactaggtccttgcctttttttctggcactaaatggcaccttaagcctacgtttgctttgactctagcccaagatcagagcactcccagtccagatataggggaggtcctaaagaggatatcctggcagtgtggaaaagctggctggcggctagtgtacaggtgacctttggaatgaacctcctatagcataatgctgctgaacagccactctgatttggtgtctcctttggccgagttacggagcagagtttccagggctgggtatggtagtcccacctcccctctttgtctcttgctgtcttcagaaatatatctcccttcaggcactcatgatgccttctgtgggttaaggtatgggcaggtcttctgtcaaagaacccaagatggtcaggaagctggttgtccaccttgatctcactttttccagtgtagaaactatgagtcagggaaaatttctgcaggcttgttgctggacagattggttggaagggcatcatagagaaattttattatcctttgtctgcttggagttttttcacttctctgtggcctcagcaactgattcatccttatatttgagttctgggatattgctggtgagaatcttagtgctgtatatttgtttttagtttcctgtgtatatgttggggtggggagggaagccagcttctgtctccaccaccattttgaaacctgaagtccagactccatttcctacctcaaaatttgtaagctctttcttcttgtattactactttgtcttctaacttgaggtttattatcattggaatgccagttgtaattggagaaaacatttatattttcagttaaatgtgttggatttcctaaaaaacatactttattttctgcttacagtatttagatcagttgtaaatgcaaggatttaaaaaatctcaacgcagtgtcctgattgcttcatgagaaagtcttttgcctcaagagtttgtatgtttctaatgagatttatttgactgaccttattcaatttgttggttggtgtgtttaaaatgttccctagaaaccataacaatctgaaagtttataaaaggtctggtaacctcacttgaattatctaaacttttacaataagtggatttaactttatttcatgagagggaaactttggctttcttgataatatctacacagtttcctttcctatgagactcaagctcaaaagattcttcaagtggtccaaatttaattgaaagccaaagtgtcttaatcataatattgtgtttcatgatcgtggcttgcttaatttttggaagaaatagtggcagattgggaattgcagtaggacgaagccaggaaggcttgtgactttgttgtttcaggccaatgagagagggttgaacaaaataatttgaggattttagcagtatacacagacaagatgggtgttttgaaagtgccttttttcccctgaaacaagagttatgtttttcctggaatttttcataatatcactaattcttaacgtggcctttgtaaaatttgttgtatattaagggcagtttcatggaaaactgtaatcttatacaaatttatgtatttaagattatagtaagacgaaaaagaagctggaggagatgggtcaaaacagtttaaagtcatataaactaatggtatgggcatgtaggattcagtttttattcagatattactaatttttaatttgttgtttagattttgtttcttattattttggcttaatgtttaatgtgtgaattagagatttaatttggaaaaatctactcttcttgagattcattttatttatctttagtcagttgctgatattcaagaaagaacaaaccacagatttagagaaggtgctggaaatttttttaaagtatcttaaaatttacataaattcattttttgtgatgtacatgtctaagttttgacaaatgcatagagtcatgtaaccaccactgtaatcaagaaatagaatagtcccatcatccacccccaaatacctcatgttatccctttgctaagtcaagccctctcctcatgcccaaaccctgttagccatcactttgttccctgttcctgtaaagtttggctttttcaggatgtaagtaaaattcacccatgttgtatcagttcattctcttttattgttgagtagtattccattgtataccacagtttatgctttcatgaattggaggacatttgggttgtttccagttttgggtgatattgaataaaattacatacaggtttttgtgtgactttaaatttttttcctgggtaaatacctagaagtaggattgctggctcttgtgtaaatgtatgttgaactttataagaaactgtaaaattggtttccttccaaagtggctgtgccattttgcattcttaccagtaatacatgagtgatccaacttttccacgtccccaccagcagttgtcagatttttttttccattttaacagatctatggtagtgttttattgtgggtttaatttacattttcctaatgactaatgatgttgggcatattttcgtgttcttattttctatcttcatatgttctttgatgaagtgtctgttagaatcgtttgctcaattttaaattgagttgtttcttttcttatggttgagttttgaggaatctttatgtattctagatacacgtcctttgtcatatatgtgattttcagatattttccccattctgtggcttgtctttttattctgttaagtttctttcaagagcaaatttgttcaatgtcgataaagtctaatttattttttcttttaaggattgtgattttattgtcatgtctaaaaactctttgtctaacccctagtaacaaaaatttttcccaatattttttccagaagttttatagttttaggttttacatttagggctatgattcattttcagttaatttttgactaaggtgtgaggtatgtgtaaaggtttattttctttttgcttatggatgcccagtttttcttttctttgagatggagtcacactctgtcacccaggctggagtgcagtggcgccatcccagcttgctgcaacctccgcctcctgggttcaagtgattctcctgcctcagcttcccaagtagctagaattacaggtgcgtgccgccacacctggctcatttttgtatttttagtagagactgggttttaccgtgttggccaggctggccttgaattcctgacctcaagtgatctgcctgccttggcctcccaaagtgctgggattacaggcatgagccaccacacaaggcctggatgtccagtttttctaacacgctctttgaaaagactgtcttctttcttttgtttacctttaaggtgctgaaagttttttttgttttttttttgttttttttgtttttttttcctgagacagagttttgctctgttgcccaggctggagtgtagtggcgtgatctctgctcactgcagcctccatctcccaggttcaagcaattctcctgcctcagcctcctgagtagctgggattacagccacacgctaccatacctggctaatttttatattcttagtagagacggggtttcaccacgttggccagcctggtctcaaactcctgacctcaagtgacccacccaccttggcctcccaaagtgctgggattacaggtgtgagccaccacaccagcctaaggtgctgaaagttttaattcaagaatttatactatacttttctatcactgtaattctacttatttagttgtctggttattatttgtgtttttatcacttatcctaaaccttccagagagggttctaacatttgcgaaggtttctcaaaacaaaattattatttgattccattcaaataaaaaaaaatcaatgccatatgttattttagagataaggagttggaaacgtctgattaatcaactctatacagattggcattttgcaaaacactgcaatgagaaaaatactggaactggtgataggagacaacgattttagtctgagctctgcccaatcatgttaccttgggaaagtcacaacaattatctggcttttgtttctcctcccattgaataagggagaatagctaataatctctaagatctattccaactgaaatagccttgttgttattcagtgttgataggacctcaaaaggtttagaaaacataaattagaaaagcaggggcaggtctctgatagtttattatatctgtcattgccaaagtgcctatttgcatgtaattctgagtgtactgaattgtttttgtaatggtgacatgagctcaaaatatggctgggatgcagacgatttcatcactcttgttaacatggtacgtaagaatttacagtgctagcagaatgctttctgtttttgtttttacagctggaccaagcaacactctccctggccgtgagggaagactaccttgataacagtacagaagccaagtctgtaagttttactcatattcaactatgtgccttaccaggctgctgtcaggcccattagttctaaggccgctgcttctttattggaaatgagcagtgtggctattcaatgaccatattcccaatgcaggaagacttttattcaggcagataaattccactccctgtctttctagaagtctgctcatcaaggctgtacaagtctcagtactcaatgcccttatctagcttgggagacagcactcccaaatgaagtaacaaagaaatgagcttgcagtcattcattcctcagaagtgcagagagctcactatcaattgcagaaataaagcgtcagaagagatacccaggagacagatggttcccaaattgtactgctttagaatcacttgggaggctttcattaaatgttgcttcttgggtcacagccctggagagtctgacttagacttgaggtagggtctgagaatctatatttttaacaggtgttccaggttaatggaggtttaataagaatcagaaaggatcaatcaagttagacttcttggattggcttagaaatctagcagtctcctggatattggaaagagctggttcatttctgacactttcaatttattttggaaactttattgaacttccaaaggagcctcagacctaggtcccctgggtctatgccgatactaacttctatacatagaaggctctggagggaagctaactaagatgctgggcagctttcttgctgaggacactcaccaaagagggttggcaagttttccttcctaaaagtggacagaatgaacatttgccaatgtggggggagggtgtacccctggtattgatggagtctcagcaaccaggctcaaaatcgtctccccctataacctatctgtcaagtcctaatgattctaccttcaaaatatctcttccatccacttggtccctcttttctatcctgactgctataggtcagattcttgttaactcttgccttgactacagcaagtagccttttaactgttactgcttctccttcatcacattgcctccttagcaccagttgacaagttctgttctcaaagcactgctcctagcatgccttcgctcccaagacagggtctaaattctttagagggctttcaaggctgcctcatgactttatcccaagtcatctttcctatctcatctggatttgttcttcccccaacaaaagcagcttgcccactgtattagtccattctttttctcctaataaagacatacctgagacttggtgatttataaaggaaagaggtttaatggactcacagttccatgtggctggggaggcctcacaatcgtggcagaaggtgaatgaggagcaaagtcacgtcttacatggtgtcaggcaagagagcttgtgcaggggaactcccatttataaagccatcagatctcatgagacttactcactaccatgagaatatgtgggggaaaccacccccatgattcaattatatccacctggccctacccttgacatgtggggattattacaattcaaggtgagatttgggtggggacacagccaaaccatatcacccacctcacaggacccttcactgcgttggaaccagtctccctcaaatgctatgtccccagtttctccgggctagatttttctctcagatcttcagtttccaagcgtgtagcagctttattaaggaagttattttgatgtctttaatgttacagttcataattacatgtttatctccctcactgtttgggaaccagacacagcattattattttttttctgtaccaccctctcctaacatatgcacagagggcctaccaagccaccttgtacatttgagtaggtactcaataaatatgttttttggtttttctttttagatagagtctcactgtgttgcccctgctgaagtgcggtggcacaatctcgactcattgcaacctctgcctcctggattcaagtgattctcccacctcagcctcccgagtagctgggattatgggcatgcaccaccatgccgggctaatttttgtatttttagtagagacagggtttcaccatgttggccaggctggtcccaaactcctggcctcaagtgatctgcccacctcggcctcccaaaatgttggaattacaagtgtgagccaccacctccggccaataaatatgttttgaattgaattaggaatagcaaaatattatttctatttaagacttcttttcttttctttctttcttttttttttttttttttgagatggaatttccctctgttgcccaggctggaatgcagtggcataatctcggctcactgcaacctccgcctcctgggttcaagcgattctgctacctcagcctcccgaatagctgagactacaggcgtgcgccaccacgcccagctagtttttttgtatttttagtagagacggggtttcaccatgttggccaggctggtcttgaactcctgacctcgtgatccacctgcctcagcctcccaaagtgctgtgatttcaggcgtgagccaccacgcccagcctatttaagactcttttcaaagcttgcttactgattcaacaaagatttattaaaggcctcctgtatgctaagtactgtataggtcctaaggtcatacatatagtaagaatagcttacagagtcaaggtataagttagtaaatcttattcccaatgcatgagaaggaggtcatttaatacctgatgcgttgagatctcacaaatatatctgaaatgagaggtgggcctaaggcagttctttaattcccattaagtaaggtcacccctgccccacccaatgacatatgattatccccaaaatgggtttatgagtatgtaagaaggaaattctatatttgctatttgttaggtttcctatcatcgttcctctcttttctcctttttttcctgagctagggagcaggactttgtgaaaactgtaaaaacctgaaaagacacagggctgctgtcactggtcttttatttcttagtgtgaaggtgggtaaattgagttgcaagagaataaatcacacctcccaccattctttatggatcaggcctcctgcttttagaaacagttctttcccattgttttattaaagcctcacttgtctggaaagaggaagtctgacctttaactttctattcttgtctcatttggagttatttcatgtatccataatatcgacggttgccagaaaactagttctcttgttgcttgatggctggacatctctgtctgtcatggaaacagtactcaagtagccgtcactctttttttctcccaaagtgttatatgggtgcctggtattgcataatgcctgcaccatactttgagtacagagtgaaaataaaagacatttatttctacctgctattttctgctcttccatgtctctcaaacatatttcctaagaagctattgtcatggtcactttgttctttatttcttacagtatcgggatgccctttacaagttcatggtggatactgccgtgcttttaggagctaacagttccagagcagagcatgacatgaagtcagtgctcagattggaaattaagatagctgaggtaagtcttcactgaaaatctctttctttcctttactttcttttcttttcctttactttcttttcctttccttttattaaaggcagtatatcctgaatgaaaatataaattgcaaacaaataatagcgttttgtgtcattgcccattgggcccaaggtagaactaatagcatcccctctaggaagtaacaaggactgtgacagaaaagctcctcattccttccacctccctggtttaagcccattcagtgtccatacgttgctcagctgtggccaaagaatagcagcagagagaccctctgaccgtttttcctggagaaactcatgtttggcttaaatagaagatagatgtttaataaatccttagtaatctggcttgaatggaaggttgcttttaatccagcccatgttttatgctatccccactcagagtcattctggcttaagttctgggctcagggaaatctgtccaccaatactggatataaaagttggtatagaaataggtaggacatgctggtaagcatttttaaacgacctttctggtattactttgtacctgcccctgtttttcattattttcttgccctactttaatgaatatcattgtgtcatatacatgacacagaactacatgtctatgtaaattaccttaacttcttgttggctcattgtagagacaaaaagatgtaaaaacaaacttgtgggcaaaataatgagaactcctaaatggttagctttgtttatggaataacttttttctagaagaaagaaagtgtaaaaatctctctatatgttcctaggccaagagggaataaatgtggtaaaatctgcttctggggaaaccctgtagtgaaaaaaatgatactttttaccaagaaagttttgcgtatgtgttgggaatcttttacaagagaagttggtaaaaatctcgagatgaataagagtccaaatgttgattggttttgtttggcgaggtggtggtggtgtgttgaggtatggagtagggatgaaggataagggtaaggaggaattggtctctctctctttgccgtggtgatgttcgtgtatagctctctccaaactcctacttgcagtgcaaaaagttcattcctgcatgtcacctttgaagactgtgaagactgctgcagatgtttcgaagtccaggactgtgcctctgagccatgtctagagtctgtctgaattctctttccaggcacataggaggcccagggctctcatttggactaaaactctgaaacagcagggaaggccttgccctgagccagggatttggaccaaaaagggaactaaaaacagctgggctgaggcaagactgggaattgtcaaaaggctaaatgaagtgacaaatctattgtgtggaggggagtggctggcagagagctgaaaacagctctgaggccaaagggctccaacttggggctgtgagactccgagggcggaggagggattggtggaagaggagtgtggatatcctctgaggcaatgattcacaccgagccaggaggctgtttgtaagttacatgtggtctctcctgtggagggtgaagaaagggaagctaaggacactgaagcatttagcaaagaggggccagacgtctgccagtcagccctctgtaatttttaccttgaaaaatcactgctagtaatgctcacttccatatcttacactacacatcactaggtacttttaaaattagtgggatacatagtcctatggaaacttctgaagctgggaagacaagacagtccagcccagccaaatacgtccttgtaattacaaccagggaagcatatacttaaccaatccagctagagagatgtgtgcacaaggagaggttttattgatggagtagcccttgtgattggaaccaagtggagtgtaattggaaaggcttgctagatgcagtgagtcttgggcagtcctgagtcatagttcaaaccatggaggtggtgatggtggataggagatgcaagagtcggagagtcatgtgtgcagtgggaaggtggcaagtttaatgcaagggaattagatgatggaaggcccgaaggcaaagtcatgacgtgattgaggggtggatatgtgagctactgctggtcaatggaagtgattaagatgatccttgaggaagataatcattgctgctgttcttaggttaaacatagtggaggctagaagctcagatttggtgttggccaaatggccaagagcatgagtattaggaattgaaagagtatagagccagggctagagagaggcaagttttgaaatgtgtgtccaggcggtgactaaatccatacccccagcaatggggctagggaaatctcaaggccaaagagacaagaggggaaatgagggaatgagctgttgacaaaatgatcacggggaacagtggcatccagatagtcttgtgttcatcagtgaaaatttgcccctagaggtgaagggatggtctgtggttcatgaaatattgaaatcattatctggagaccacaggtgacaatgggatgtttacctcaatgtccaacttaagtttgattgtcaaaattgagccagcaatagattttgcccatccacattatagattgggagggagatttggggtagttctttttgtactggggacaatatttcacacagaggaggatatgaaagtttattttcttaatcctgcctaaagtgatgtctttttttctcttccccgagttggggaccacaccaaagccttgaaaaactttataatactatgcagatgttttggcacatgtaggaagtaatcatacagtaagaaatggttcacttgaaaaaaaataacaaaaatctcttttcaacagataatgattccacatgaaaaccgaaccagcgaggccatgtacaacaaaatgaacatttctgaactgagtgctatgattccccaggttggtgaaaactatccagaaaactttctctcaactcatcattttagaagggattggatttcatctctgtgtaaatttgtgtcttgtaaaacctgctctcagtcttggttatcatcatctttgtcaacaatcacataaaatatcccttgtctgtgtattgggatgccttctgttacagggaacaaaacatctttccaacagtggcttagaaacttaaagcctatattctcacatgacaaaagtctagacataggtaattgttggcattggctcagctgtttaacagtgttgtcaaaggcccaagttctttctatctttccatcctactgtgtttagtgtgttggctttttgacttcatgtttgatgactcatggttccaaggtatccatcacagctccatatatcacatctgctgtcagagcaggaagaaggtgaaagggccagtgatgtgtctaactcttttactaggaaaaacaaacaagcctttccagaacatctccagatgtcttccctttatttcttattgagtaggattgggtcacatggccactcctaaccacaggggaggttgggcaagtgagtaactggttttccgtttcaacagtggacacaggcaaggaagaaaaggttgggaaaagacttttagagtagccaatctaaaaaacaccatatggtgttttaggtaggatagggatgctctgaagaatggaggcatgttactttctgtgtttttatttgtttttttttgagacacagtcttgctgtgtcatccaggctggggtgcagtggtgtgatcttggctcattgcaacctctgcctcccgggttcaagtgattctcctgccttagcctctcgagtagctgggattacaggtgccggccaccacacctagctaatttttgtatttttgatagagatgggattggccaggctggtctcaaactcctgacctcaaatgatccacctgcctcggcctcccaaagtgctgggattacaggtgtgagctaccatgcctggctgcatttactttctgttgctgcttatttcctcttgtgtttttttttttttttttttaaaaactgtgtcacagagacaaattatgtactggggcatctgtttctgtgtgtatgtgagagtgagggagagtacaggacagagaaagggagggagggagagagaaaatgtaccgtatagaggaagaatttagaaggaggaagagaaatgcaggagagaaggagggaagagtatgggaggaagaaagagtatagaatagaggaagagtactggacagggagagagcagaatggggagagaaagacagaggggagagttcaggaaggaggaagagtactggagggggccaagggagtgagggtgcatattactgtgttagtgtgtgtgtgggtgtcgtccagatgtagatggtacagaacacatgctccatttgtgattaagacaataggtcaggccgagcatggtggctcatacctgtaatcccagcacattgggaggccaaggtgggtggatcacttgaagtcaggagttcgagaccagcctggccaacatggtgaaattccacctctactaaaaatacaaaaaaaaaaaaaaaattagccaagtgtggtggcaggtgcctgtaatcccagctactcaggaggctgaggcaggaaaattgcttgaacccaggaggcagaggtaacagtgagccaagatcatgccactgcactccagcctgggtgatagagcgagaatgtctcaaaaaaaaaaaaaaaaaaaaaaaaaaaaaaaagacaataggtctggatggcaatgatcaggagtttattttctagacttgagtagttgcatcttgaattattaggtgtgaaatcaaaagaaatgaatgatgctcaatctactctatctgcctttcttacttgctacctaaccgagattctctcattctgttttgttctctctcccctcagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagtaagaactttcacatgaattttactgtgacttttgtgttttctttaaattataagggcttcccttctcacatcctttgaaaactgtttttaaagaatgttacatcaaaagagtcatagggaaaatcccggtgtcctttgtgatgaactggccaaaagcactgtctggtgtaatttacttgctgcaatgataacaaatgtttttgccctttatttctggtctttctccatgctgttctctttgagatcctaaattgtttatgagcttggggagctagtcatataatgatgttattttctaaaatgtctgtgtgaacatctttttttttccccagttcattctcaatcttttgctgcttttttttttttttcctggttcctttttaaccattaagtcactttctggcaataaactaaagtaactgtattgagaagacacaagaccaccttgagagtggtagaaaaattgcacggataaaacaactttaggaactgccaggtttttcttattttaaagaatgttttagaatttgttgctttgctagtttattgctacaaagaaaaatcttccaatattccaggaaggagaattttacaggttccttaaggcattcagctttgactacagaaaatgaatcacagagcttacaaaatgaatcaacgagtttacaaaacactttactgagttaattgctgggccatgattaaaatcacattttcttatttggactcagacaaggctatgttgccagaagttacgttttttaaaaaaggcacaacagtccttggaagaaaatgtagcatttatcccctacggaaacacttagacacctgagaggagctgctgctctttttaagatactttctgatgataaaagtaatctgtgttcactgaggaaaacatacagaaaaaggagagaagaaacaattaatttacttaaaattctatcatttagagataagccaggattctttgaaaatgttctaaatggaaattgaatctagaggtacgtaattatattgcagggtagagccttgctccatggaccaggaatgtcagcagcatcacctcgggtgcttgttaaaaatgcagattccaaggccctcctccattgagtctgatccagtagagctggaggggaggccaagtaatctttattttaaacaagtacctcagaagaatcttatgattaacttttcttaggggaggggaaggggatcactgtattagaaaatttctttgtaagtacttcctagctctcaaatactataaaatatgacccaaacgattttctactcatatgccattgagttacggagcacattttaaattttggtggtaatttccattgaaaggtggagtttggcctgctttagattcatccttcacctcgtgagtcagtttcttctagtatctgtgttaaaagagtaggtacttctgaacactgattgattttacttccaaaaaagcctaatttacaatcaggggatagattgggatttggtttactgtattagaaaaagcatctctatcgtgatgattttacttggtaattgcaggacctttcataacaatggaaaagagcatgattggagggagattttactctgattcttgtcaaaatgataacttggacaaatataaacgtagagaacaacagtagaaaaaacatagatggaaaagtcaccttagatgttatgtacacatacaacttcatttaaaaataaggacaaaaattggccaggcgcggtggctcacacctgtaatcccagcactttgggaggctgaggtgggcagatcacttgaggccaggagttcaagaccaacctggccaacatggtgaaaccccgtctctacttaaaaaaaatacaaaatttagctgggcgtggtggctggcacctgtaatcccagcgacttgggaagctgaggcaggagaatcgcttgaacccaggaggtggaggttgcagtgagccaaggtcgcaccactgcactccagcctgggtgacatagcgagactctgtcttaaaaaataaataaataaaaataaagccaaatcccaaatctctttcacacagtttatccctcaaccaccagtttataaaaagcaacttgtgttctgcgtattcttgtgagatttcaatacaacgtacacatcatgagaagtctgacagcattttatttgcagactatggtgatgttttttcattgatgatcgtgtttaatcaccactcgtgtagcattacagggctacttgaggaaaagtcttcttgggttcccataattgccatattggtcaggatatgccagttgctataaccagcacctctaaacactcattggctaaattgtaccctctgctcatggaacagtctgaacatgggtgtccctgtaagagagctttcttctaaatagtgacttaggaagccagactcctttcatcttatggctctgccctcccttggatgtttggcatcctctctattcagctggaggatggagaaacagagagggtggaggattgtataggttttggtgggaaggcctagaagtggggtatgtcacttctacccataatccataagccagaactcagtcttgtgactcatctagctgtaggggagactgggaaatatagtttagctatatacccagaaggaaaaggagttggagtttccctagacatgcctttatcaaagagcctatctcattttcttgaaatgaccacttttctctcaatggcaaatacttccctgctccctacctctatgacactgtgagcacctcatggcaggcactcttttttaatttttaatttttgtgggcacaggacatattttgatacaggaatgtaatgcataataatcacatcaaggtaaatggggtatctatcccctcaagcatttgtcctttgtgttacaagcaatccaattatactgttttatttatttaaaaatgtacaattacactatttttgactatagttacctgttgtgctagcaactactaggttttattcattctttctatttttttgtacccattaaccatccctccttccctccttcccctctgctatccttcccaacctccagtaaccacccttctattctctatctctatgaattcaattattttaattgttagctcccacagataagtgagaacatgtgaagtttgtctttctgtgccaggttatttcacttaacattatgatctccagttccactcatgtttctggaaatgacaggatctcattcttttttatggctgaatggtcctccgttgtgtatatgtaccacatttttaaaaatccatttatctgttgatggacacttaggttgcttctggcaggctgtcttgtgattgcttttttaagtgttgtgacctagcacagtgcttctcatgtagtagacactttaaaaattctagaagttaaccagataccccatcaccaccacaaggaggtgacatatgaatggaaccccaaaggataaagaggaattttctaggtagggaagaatagagaaaaggggatggtaagcatcttcagtggtggaaccaatgtgaacttgggtgttgcctgcaaggcagggggctagagagctgagaggccagcttgggctcaggatatgtagaggaaaagcatcagatgaatgttctgaggatccccccacctcctacctttcccttggaggcaccattgaagaaaaagccagccaagccttctcacattgggcatctctgctgtgcctctgtttcgagaatctgcctataaaaatcatatacaggtaatggtgatgttaaccaccactatggttaacatctttgatctttacaacaattctatgcgttgttcccactttacagatgaggaagctgaggttaagtgacttggccaagatcacacctctaagaggaaacagagctgagattctaaatggggtcaccctcatttctatgtcttgtctctttttttccataaatgtcttggtgtgaaaagagatacttttcagatgcttcactgctcattttggagatgctagcgtattgtaccctcagctagttagatattgctagctttggcaattttcctgcaatgttcagcagttcaaagccatcctgtgttggtgtcagctgttcatttcttattttttatttttatttttatttcaataattttgggggaacaggtggtgtttggttgcatggaaaaattctttagtggtgatttctgagattttggtgtacccatcacctgagcagtgtacattgtacccaatatgtagtcttttattgcttaccccctcccactctccccctgagtccccaaagtccattatatcattcttatgcctttgcattctcgtagcttacctcctgcttataagtgagaacatgcgatatatgtttttccattcctgagttacttcacttagaataatcatcttcagctctatccaggctgctgcgaatgccattatttccttcctgtttatggctgagtagtattccatggtgtatatataccacattttctttatccattcgttggttgatgggcatttatgttggttccatatttttgcgattgcaaattgtgctgctgctataaacatgcatgagctagtatcttttttgtataatgacttcttttcctctgggtagatacccagtagtggtattgctggatcaaacggtagttctatttagttctttaaggaatctccatactgttttccatagtggttgtactagtttacattcccaccagcagtgtaaaagtgttcccttttcaccacatccatgccaacatctgttatttttttgatttttgattatggccattctcacaggagtgaggtggtatctcattgtggtttggcacttccctgataattagtgatgttgagcatttttcatatgtttgttggccctttgtatatcttcttttgagaattgtctattcatgtcttttgcccactttttgatgggattgtttgtttttttctttcagctgctcatttctcaattgctgcttctcccttcttatattactcccactgccagtctaggggattaggcctctttctctgactgagtggctgtggggacagtggcactgactctttggtaggtggtgcatggtacagaattagagcaatgagatcctccagtggtggtggtgccaaaccacaccagcccttgcagtccaagggggtaggtggccagggagggacccttggaggaatgagctggaggctgcctgtggggaacaagagctggtgtttgaggtggaaaggggggtggggtaaggaggtagtgatgatccctcatgttatgtgcatctcttcctaactacatgttcggtgatctcatgttgatagtttcaattcaactatgggggattttgacaccatggaaattggcaaatgtaacaaatcatttttctttttcttgacaaggcagttggcaacctttactagcacatcactgggtgaggggcactatagacttctctccctttctgtccccctcaattctcctcctcactcctgactcgaggctgcctcagacacttcccatctacttttatctgaggagtaagagtgggaggaggagaggccaaggaaggttggcatcaggaggagctgacgtgatttcctcttgcaggccagggctggatccatggagatcatctgcgccaggactgttttcttttgttgttgttgttgttttgttttttagcagactggcctagagcaaacccttggagttttgtcaaggaccctgtaagtattcctgtctttagttttattttcatataaagcaagtacaatgtacattaaagtaagatgattcttgttgcatgttcccaaaggatgacctggaaaatgtgctgttatgtggacctctcctgggggccagctcttctgagagtgatctagggtcttgctagccaaagaatggcctacagatgagcagcagagacattactggggagtttgtcagaaatgcagactctcgggctctgccccagacctactgaatcagaggctgaaattgaataagatccccaggggactcatatatacattcaagtttaagaagcactgatgtgggatttaggaagtcctagttgagctgtgtgtgcagaacgatgcggagatggagttttcctagaccagctgttttcaaacctgacacgcctcagaatcccctggagggtttgctaaaatacagtctgctggccccccaccccacagattctgattcagcaggtctggcggtaaggcctaggaattttctaacaagttctcagatgacgctgaagctgctggctcagggacacactttcagaatcactgccttacataagcctctaggcagcctgtaggaagatctctggctttgagaacctttaagaagagcctctgtggctcacttcagatagtatgaccaagacgagcaaatgcaagttctggaatctgaaaacccagatgttagtcctggatttgacacattcttggaagtaccttgacctcttacctttgttttcttcacctgaaaataaggataataataataatcacctcacagcactgttagaaatatcaaagaaggtattttatgatctcttaaatgtgatacaaatgtaagctgccactacaatttgagtatcccttatccaaaatacttgggattggaagtgtttctgattttggatttattcagattttggaatatttgcattataattaccaattgagcatcccaaatctaaaaattaaaagaatcttccaagtcagaggctttaggaaatgatttcatgttgctctctttgtggtgggtgctcttttgagatgctttgcctttctctgtttgatttattgccacttggggaaattaccatatggctgaaaatgtgtttttttgggaaaaaaggatattatgtgttattttcaaggactgttgctgactgtgatttttgctttttgatatatctgagcattaggtgacagtgattcagtcattatggttatatctgttcctggcgtggtaatattagcactccaaaactgtgctccatagcattctgtcagtgtatttataacacactgaagaaactcatcagtgccattgtctcgctgtgtgaacttctcagcattacagcttccagcttgcagaggtctggttgttatgctatcacctttgtaatgccttgtccaggaagtcctcgtaattctttttgtgcccacagatttctgtgaagcatctttgttggagtgttttggggtctctgtgactggccaggaaatcttagctaaattagaggctttggccaggcgtggtggctcacgcctgtaatcccagcaacttgggaggccgagttgggcggattgcttgagtccaggagtttgagaccagcttggcaaaatcatgaaaccctgtctctaccaaaaatacaaaaaaaaatgtgctgagcacagtggcgcatgcctgtagtcccagctacttgggaggctgaggcaggaggttaccttgagcctaggagatcgaggctgtagtgagctgagattgtgccattacactccagcctgggtgacaggagtgagtgaaactctgtctcaaaaaaaaaaaaaaaaaaccaaatagaggctttaattcatcactatctggcatagggaaaagcatgcaggctttagagttagacacacctgggtctggtccggcctccattgcttattacagtggttcttcaacttggcctcacattggacttagctgaggagatttataagcaatatttatgttgggtcccactttagagattgtgacttaattggcctggggtggcctaggcatgtggacttttaacaacttccccaggtgactctactagtttgagactcactgaatatgtgatcgtgagtttacttaatggttctaagcctgaagtctcctcatatgtaaaatgggtataataacatctctcttacagcagcactgtgaggatcataattaatgtgagatgcctaaatgggatgatctcaggggagctggaagggcccctgcttctcaaaccccagtatactttgccatactacatcttccaccaccaccattgggccccctaacaacttccctagttattctggctcatcaccacccctttgagggaatatcttttgaactgatgaaaggacatctgctggctgttgacctccttctcgtctccacctatggatccagcatggttcacatgcctggtaagaggtattttagagacaaagaacataaagtccttgcactaggaccaagatcggcccattaatgtgctagacaccatgacctggtcgctgtctgcatctccccagtgtggctggcctttctgcccacttccttgagtgatgatcctgttcaccatcctctccaacatatcagccgattccaccattatttagcctgtccagagttcacgttcctgtttgcaacaccaaagccttttaacctttcggcatgcttctctcatgaagcctactcttaaccctcagtttgagatgtactatccttacagtgaagtgtctggcacatacttttgggtgctagtgtctaccaaatcattatttatgcacttgcctcatctcccctgctcagctaaaagcttcaggaaatcagggactatccatctccccagcacagagaactgttagtatatatgtgggtgctcaggatgtgttgattgagtgaatgaaagaaagacccttatgtactgacagtgtgtcccttcaattaaacaacccaattacatgaacaagctgaaatctgaagtcctgtgttcccagctggactttgagttctctaactgtaggtgctgggttcttacttctttacgttcctcatggcatctggcacaatacttggccaacaataagtgctcagtgagcacttcttgtcctattaaggagtggagatgtgaatgcaaaagagccaaaggaatgaccccaaaccacttagtggcctcaacagagatgggcaagggctggactttgctgattagtgcagtggtgtcttaggggaatgcgcatatcctaacaagatccattgggtctgagaagaacattttagaacttctatatctttatttaaatttaaaaataattaggctttatacagagtggtataatggactttggagactcagaagcagggagggtaggaaggggatgaggcataaaaaaactatagattggatccagtgtacattacttgggtgatgggtgcactaacatctcagacttcaccactatacaatttatccatataaccaaaaaccatttacatccccaaaagctattgaaataaaaaaactttataaagaaaaataattacactttattgagttctatattgatggctatggacccttcatttgatctgtatggaacatgtgagaggggcactgtcaccctcactggcttgttttcattcaatatattaaaaataatctcagctgatacggtggctcacgcctgtaatcccagcactttgggaggctgaggcgggaggatcacctgaggtcaggagattgagaccagcctgaccaacatggtgaaaccccatcagtactaaaaatatagaaattagccagtcgtggtggcgggcatgtgtaatcccagctacttgggaggctgaggcaggagaattgcttgaacctaggaggcagaggttgcagtgagtggagatcgcgccattgcactccagcttgggcgacagagcaagactccatcttcaaaaaaaaaaaaaaaaatcttgagcggtttacatatagctgtggatttatgaattttattatctagtttatctagtttactacttacaaagtagacaagtggcttaaaaattcttgcaggaaacaggaattgaaatgattattgatgatgtaagcacaagagaacagctagaaattggcagaagtgacccttctcccaggctggtatgccatgttggttagccagatgacaaaagaaatacaatggtggtctaacaagaacaaggacaatggcaatctgacaaagacatgtcatacatttttgaaatagtcaagaagactctaagaaatgtggatttatattcattgtcattgttgtattaaccaaatcctatatggacactgtgtcttgaagaattaacccaatggtgtttgaagaattaatgacttttgaagattttaaatttcattttacctcatcttttgaaatttctgtttttgtatttgttaaaaatattcctaatatattagtctattagtatatctctatagaaattaaacatccatgtattgggtgtgtatgctgaaaaatattttactagtaggagcgcatgtccactgtgtcagaatgtcatacaaatgagagtgtagtttgttcttgatgggcttttagcatcatcatgtcatattgctctcatgtgattggctcaccagaaagccatttcaggaatgtgtgttattagtcaccatggtaatggcacagctgggaggggaatggatcattaaagatccatcatcactattgagttagaaattaactgagatcacacattcttctgaggtcaggtcatcttttgcttatagaaaaaggcaacccttaaaatttaacagatttttaaagatatgtattataggcattacatgagcttatgaggttgttcatacatttggaagtgaaagacaaaaccctagaaattgactatttgtcaagcattttgttatttatttgaaccctgcaacaactctgtaaggtagggatcatcctcattgtatgaaaaataaagataaaatcacagaccttaagtgacttgtcgaaactcacatatttagtaagtatagaatgagggtgcaaaattagatgattggtattagccaatattttgctgttagtttccaaaggcaaagaatacataggcattgtatcaagtcacctaatccagtaagtcctcacttaacatcatcgatagcttcttggaaactgtgactttaagcaaaatgacagataatgaaatcaattttaccataggctaattgatgtaaacaagagttaagttcccatggcatattcctgctcacaaaaacatcaccaaacttctaaataaagaccaaaacacttctaatattgaacattgaatacatgtgagctatgcgtacatttaagaaagacaaataaaagcaagtaagataattttttttgatctttggaacccattcaatgtttttgtagacatattcttttttttatccttgttttcattttttaaattatactttaagttctagggtacatgtgtacaacgtgcaggtttgttacatatgtatacatgtgccatgttggtgtgctgcacccattaactcaactcgtcatttacattaggtatatctcctaatgctatccctcccccctccctctatgcagccataaaaaatgatgagttcatgtcctttgtagggacatggatgaagctggaaaccatcattctcagcaaactatcacaaggacaaaaaaccaaacaccgcatgttctcactcgtaggtgggaattgaacaatgagaacacttggacacaggaaggggaaagtaagataattattaacccagttattctagttcagggttgcaggtgctggagcctatctaggcagctcagggcaccaggcaggatccagccctggctaggatgccatcctgtcacagggtgcagtagctcaccatgctcactcacactgggaatgtgtagacacgccgattaacctagcaggcacatctttgggatgtgggaggaaaccacagcacccagagaaaacctgtgcagacttgaggagaatgtgcaaactctacacagacagtgaccctggcccagaattggttttttccttatcaactgtataacaaaaggatgttgaatgaaatgatgttattcgaggatctgctgtaatttgaaggtactcacaatttccagacacgaaaggctgtgtaacagtggactttataccctgagagtgaaagtaaaatgttcactctgagggctggagctggaatctttccttcatctatctctgttaggtggtgaaaagcaagccaattttggttgtgcttattgacattgtatcatcttatgtcatttctcaagtgaaagttctgcatttttgtatgagtaagaggtccctcgatggagctttgccaactgtttctctcaagatgttctgcagagcatcagatattgacctaaaatacaataaatgggcatctctctctgttaacaggaccattgccaactatttggtgtggagaatggtttattccagaattccaaaccttagcaggcgctttcagtatagatggctggaattctcaagggtaagtttaagaagattgcagtgttacatcgctggataactttacatgctggaatagtccatatattaactgatccagtaaaaatcatctttagggattagacagggggagtttgtagcccaagctctattgtttttgtgtgtgtgtgtgtgccttatttatttttatttaggtataaattacatatggtaaggtacactcaagttttactttgatgggttatataaagatatttagagaaatacttgaggccacacattgttttcaaacttccccgtcttattagtgtattcccattttcccccagagtttttaactgggtcactgtaattatagttttaacatttctttgtgatatatttgtaactatcttttattctcagtattctgaatatttaaaatgtgcatgatagagatattggatggtagaacttcattttcaatttggaaatggaattttgtcttaaactttgcctataccttccatctttgaatctatcctctgctaggtccaagaggctccaatttagttttcttgctcaactgtctgagatggttttcctccacctgctcacctggctctttatttatttatttttattagagatggggtcttgccatgttgcccaggcttgtcttgaactccagagctcaagtgatcctctcacctcagcttcccaaagtgctgggattaaaggcacgagccactgtgccgggcctcacctggctctttaacctttgcttctctcccacccttgctcgtctcccagtttgtacccatgttactctcacctttgtttttgaggcttatgtctgactaattctcctaccactagaggccgtaaggattttgtatctttgaaacagtttttatttttctatcaatttaaagttaagtgaatggtgaatcttataagctatgatttcattcaagaggcattttagttattagaggaactaataagtatagaaattcttagtgggccattactctggaagagtagtgcaattattttggatatgctttgaccctataaagtcactagcatataaagttactttagggctgggtgcagtggctcacacctgtaatcccagcactttgggaggccaaggcaggcaaattgaggtcaggagtttgagaccagcctggccaacgtggtgaaacctcgtctctacaaaaaatacaaaaattagccgggcatggtgtcacgcacctgtggtcccagctactcggggggctgaggcaggagaattgcttgaatccgggaggcggaggctacagtgaactgagatgatggcaccaatgcactccagcctgggcaacagagcaagactccgtctcaaaaaaaagaaaaaaagtcttttttacagagaacagcataaaacaactatatatatatttaggtcatattgatgggttaagatacaaaacaagtaggttttgtgtgtgtgtgtgtgtgtgtgtgtgtgtgtgtgtgtgtgtgtgtgtgtttgtgtgtatttttaactgctacgaatcacataaaagatgatgcccagctgctttccacccctactgtgaagagaatgagagaggtgtaagaagcactgtgtgaacatttaaggttaggtatgaggggatgtttcttgagcacgaagtgctaaatataatattgaattgccgaagaaggttgtaggatctctttctctagaggttttaaaaatagattcatcgcttacctctgagagaggttaccagaaatcagaggaagaatagatgaaattaagccttaatcccattcctcaaaacaacctgggtctaacattgtgcaaaggacacttctgaccaccattctcagggcctcccttcctccctgcctgcacccccagcttccaagggcaacttacactatatttatttctctgcttttattcccaagagtaaacctctgacccaggtcctgcttgggaaacttcttacttgtttgtaaatgttttcttgcaatggtataattgggacagatgggcaaagcatttacatctgtattttgcttgtttatcagtgtgttttttgctgtgacacaatgtaaatatgctccctgtgttgttcatggtgggccatgttcttctggtctgccttgttgagtgtgctactcggagcaaggaaaccctcactgggcaggaactttgatcacccactgattctagaccttcttagtggaactttagttctcaggagatattaaatattatctagacacttggatagcatcctctcatgtccctgctaactgcagaaaagtgataccattgtccagattctttgtttaatggggaaaattgggaagaaaggatacatatattattttaactgttaaatcactttcttttcttcttcttctttttttttttttttttttttttccagacagagtctcactctattgcccaggctggagtgcagtggcccaatctcagctcactgcaaccaccgcttcctgggttcacacaattctcccacctcagcctcccaagtagctgggattacaggcatgcaccaccgtgcccggctaatttttgtgtttttagtaagcacggggtttcaccatgttggccaggctggtctcgagctcctgacctcaggtgatctgctcacctgggcttcttaaagtgctgggattacagatgtgagccactttgaccggcctaaaacattttcatttagtttgaaatataatggggacaagcagaatttttttcttcaactattttacctttgcctctactatctgatgcatatatatgggttagggtgtgcagtgttttgtagactgttttcttcaggttgtttgaattgttttcagccatgggttttatccaaatgaagtttaatctggatcaattatctcccacaggtaatccaggggaccacaactttgctgcctcaatgggacaaatgtgtaaactttattgaaagtgccctcccttatgttgttggaaagatgtttgtagatgtgtacttccaggaagataagaaggaaatggtaagtggtactccccagctagcaaaaaataatggcaatttagccagatctgacaagggtatattcaacaggctaatgtcagccttccaggtggtagtggcctgtgggtattgtcttcagattctttcaacttctaagtgaaataggaagaaaggtcatcaaacgagagtgaggatgagttagcaggtattgaaggttagaggagagagaaggtgtgtagttttccaggggagtgggagagtgaataaactgagggaatgtagtatagctgcttgagggcaggcatgtccagatgtaggtgaggtttgaggtattgaatttaaagagggactcatcactgtggcaacgtgttcttctccatctgtttcaactgcattggagaaaagggtgtatttttttttctttcagctttattgagatgcatttgactaataacaattgtatatattcgaagtatacggccgggcgcagtggctcacacctgtaatcctagtactttgagaggctaagccgggcagatcacttgaggtcaggagtttgaggccagcctggccaacatggtaaaaccccatctctactaaaaaaaatacaaaatttatctgggcgtggtggcaggcacctgtaatcccagctatttgggaggctgaggcaggagaattgcttgaaccccggaggcggaggttgcagtgagccgagatcgcgccactgcccttcagccaaggcgacagagcgagactctgtctcaaaacaaacacaaagtatacaagatgatgatttgacatacattgtgaaatggttgccacaatcaaatgaacacatctgttgtcacacttatttaccattgtgtgtgtggtggtgggggatgaggacacttaagatttactgtcttagcaaattcaagtatacaatacattattagtaactatagtcaccatgccatattttagatccccataacttattcatcttagaactagaagtttgtaccctttgatcaatatctccccatttccctgcccccagcccctggcaactactgttctactctctgcttctatattttaacttttataaagattctacatataagtgagatcatataatatttgtctttctgtgcctggcttatttcacttagcataatgtcctctggctttatctatgctgttgcaaaaggcaggattttcttcatttcttcatttttatggccaaatattccattgtgtggtacacacatgcacacatcgcagtttccttatgtatttatccattgaagggtatttaggtttattccatatcttggctattatgaataatgctgcaatgaacatgaaggtgcagatctttcttccatatactgattttacttactttggatatatacccagtagtgggatggctggattgaatggtagtcctatttttatttttttgaagattttccatgctattttccataatggctgtaccagtttacattcttaccaacagtatatgagcgtttcctttttttccaggaatattttgccaacacttacctcttaaatttttgatcatagccatcctaacaggtagtgaagtgctatttcattatggtttgatttgcatttccctgatgattagtgatgaaaaccttttcataaacctcctgtttatgtgtcgtctttggaaaaatgtctattcagatcttttgcctattttttaatcagattattcgttttttcactattgagagggtgtattttgaattagaaacatggatttggccaagttttttgtctgcattttatttttgatgaattatattttacaaatgtcatgaagtaaaagatccaggcatgattaataataatccgtgtagtcaataagatacaaatatatgagcagcttggatgcaggtggtcaataaacactgaattaaagggcaaagacattgtaatgtcatgattgttcaaatgattggtatcacgtagtgatacataataataccaaatggttggtattatgtatcagtacatagtcattattgatacataatacatgattatgtattatgcactgaagtttgctttgcaataccatatctaagtacatttgtggcaggccaggtctcactaacacaggcctccatcacaactgtcccagcacgtactgagtagctaggttaaacattaaaagctgattgaaccactgcccatatacaaagcctggaatgtaacaaagagcccaccaagagttttgcctaggcttttcctggatcttgaagcatgacaagataatgaatgaattcttaacaggacccttttaggattaaacaagttttattgggggtctgaagaaactccacaggcctccacaaacaagtttactggggtctaaaggaactccccaaacctttatgatttagcaggagacaagataagggtaattacctcagtacctagacccatttagattaagtaaacttactgaggctccagaagaaggtcttcaagactcacacctagttatagattaaaagaagttaatcatttatgtctttcgacgattgcacactttcacgtagacatatagcttagaaggtatatgagctctagaaaactttgtaactttgagttggtctggtgataatttccaggctttctccctgtaaccagtggcagaaaataaaactctgttcttccccagttcatttgcatctcgttattgggccgtgagaaatagcagcctgaccctcagtttggtctgggaacaaattgacctatgttaacttgtttttactgtctaactatgagactttatgtttgaacctgaaagttcccttgcaaataattccactgaggaattaatggcttatttcaaaatactcagtattctcattgcgtgttttcttttgctctttggtcagagtaaatagattgagatcttatcagataatcacagtagtaatattataatctctgggaaggctataaaaacaattaaaggataatgaaagatttaaaaaaattatagcaggttttttggcagtagaagaattttaactaatatgaaaagtatgtggattaaacttgtttttctcagttttggtgtgaaagtcccttttccttgtgtcagggtatgacattctaaaataaagttaattttggcatcttcccccttattttgatgtacgtgggggtagtttggtagttaggcagatactcatctctttaacgtaaaattgtttgcctcccttgtgctgaagctgtttgcctcagggaatacttaggttggaaacttataagagaaatatctggccttttatagcctttttttttacagggctcccatccaagaaccacctggaaccactgatttacttgaaaaacattcagtattattagctacagtctaaagaaaaagaaaaacagaaagatccccaaaggggcaaattccagagaccctaactcagatggaaggctgccattgtttatttaccaaaaaagtttgttaagcaaatgaatacagtcagaagcttaaacttcaggtatgtctcaaatttacatgtgtacataaatcacgtgagcatctgcttgttaaaaatgcagattctcattgcattttaacaaggttttttttttttaagttgtgtttggggtaggacccaagaatttgcctaacaaggttccaggtgcgactgctgctgctggtcgtggaccacactttgcgcagcaaggtcttctcatgattcatttgtttgtaaacagcaccaaaaaaaaaaaaaaaaaaaaaaaaaagcctcggtgactcacaagagcaggccaggccagttgacatgaatagcagtactttatttaccaaaaccggttacattagtgcaagtaactgctttaattttcagatcattgaaaatttctgtgattcagattggtttaaatggactgtgaaaaaccctgcgttaggacctccaggctttatcttttgaaaactgatacctaggttttactaagagactcccgccccacttctcctccgtgtctgttttgagaacctcttgatgacagagttggcccaactgcctgtggttggtaccctctcttctaaagagtgagtgggagagagcagttcacattgaggtttcctacctatcagtgttctcctccttttcactggggaaaacacataattctatattactgtttcactaagacttcctacatccaactgtgcatttggacacaccgatacaccaacgttctcatactcattcacacacacaaccatgggaatttagcaaattgaattagaaatgagaagaatagcatgtagaaaaggagagtccttcaacagaaagccaccaaaagaggtcatatagtacaatcccttgcctcccagttagcaggacagagccttaactcgtgagattggctgcaagtgttgctttgtctttgcagtccaaagtagcactacccaattgaactggaatatgagccacatattttttttgagacagggtctcactctgttgcccaggctggagtgcagtggcgtgatctcggctcactgccacctccgcctccctgtgttgggattacaggcatgagccactacccctggcctccattgacttttatattaacattttctccctccttacctccctttcttcccccattccccagaactaaaaatcataactttgtctatcagaggacttctttaattttttatcttatttagatgaagattatttataattttaaaacattccattagctaagcatttaatattacttttgtggaaagttacatgaaagtgggactcccctagagaattgatgatatatcatcactgtaaatagagatgatgctctcgttccactgtgccaagccctgatccatatgctcatgacctaaatggcaggagagaggattagttgtgttcaggaaggatgtctagagttatcacttgctaattttcccctttatttatttttattttttaatactcttgtctttttctttttcttttttttttttttgagacagagtcttgctccatcacccaggctgaagtgcactggcatgatcttggctcattgcaacctctgcctcctgggttcaagccattcttgtgcctcagcctcatgagtagctgggattacaggtgtgcaccaccaggcccagctaatttttgtattttttttgggtagagatgtggtttcctcatgttggccaagctggtcttgaactcctgactttaagtgatctccctgcctcagcctcccaaggtgctgggattatagacgtgagccaccacgcctggccttgtttgattattattattattgcttatatctgtaatgtataagtaagtgccccaggtagatactcatgtccatggagggcaggtgaaggttccaacgaaggccagggaatgaagggattgtcaccatgggcctagttgtgactgtgatggtcaggacatattggttttaaaatgtggtgatgataataacagtagcagttagctttcactgaggtttaactagctgtctggtattcttttaagtgctttcagtgtgtgaactcacttatcctcacaatgaccctgttactgctgttagtgccctcattttccagatgaggaaacaggctcagagagttgaagtaaattctctggagtcatatagcttgaaaatggcttaggtagggttcaagcccagacaatctacatggaaaccagtgttccattcccttgcttatctctgaaggcacttgaatctttgccagttttacgaatatgaggagaccagaaccttcttagtggcttatcttataattacccttgttagcaaattattctaatattaagatcctaaaagggcatacatttcatattttttaacatttcagaggtaggaaacagttggaataggtttggcttccagtatttcaaaattttaaatataaatatagtggaaacctaattcatatccaaccagttgacatcacatttttgtattcatataattctcaggagaaagacggaaatgataagaagcaagctactattgatttaatctaagaataaccttgcaggtatatctttggctcagtctacacactgagctcaatttctcgtattttgtacatacgtcattctaaggagtgatccctgatgtttgcagtggtaacccaaaggctctgtaagatttattatcaaagtttaaaaaaaaatgtttaccattctctactaaggcggaaatgtgaatatatacatcaaagaaattttttttctattgtgttgatgggaaaaaaggccttgttgctgtaactctagtttctagaaaattcagtaaagctgaagttcccatgtgaacattttggctgggctaagttcttctgtataaaccatgtcttggtttgtttcattgtagacactatgtccccaaactgcttatctttattcatatatctcatctctgccagtaggtattttttgctgctccctcaaattttctgcatttttcttatagagtaaaccctgctaaagcaaataattattttgacacttgttaaaatagtaatgaagactattcaggactattgcaagaggtgtcaagtctattgcaacaggggagaaagattaggcccaactctaaatacagcaaagatagctggagatttatagccagtgaggagaatgagggggtcagtggatggaaaattatgaagaggagacatcacgagcagggaaattcttgttaaaccaacttgacaggattcttgtggaaggcaggccaaggtgatcaggatggggattctttctaaagtgacttagcaggattcttgctacaactggactagacaggcttgtcgaggacaggatgggggtgggaggctgggaggagggtaagggcaagacgtacttgagaagagggctcagaggagcctgactaaactttggtcaaggagagagtctttgtcagctctcagatcaaagctaaagtcactgatctcctgtcatatattaaaacattctatatgcagaaggttaatctagttaaagcagagcaaatctattacacttcagattcagattttattaagtgaagaactaaaacttgactccctatgtagaacaattcactaatttctcctgcactctagcagctattctatttctctttaaagacattgttcatgtccccaagtaatgccatggatgccctaaaatatcttccattttttctgagctgctctctgcctgagcaattccagtagtaattcttatcctaagaaaagaattctcctcccaccccatactgctacatctggtgttgaagacttaaatacccacgtgggtccaattgcagtggcggagtttgaacttgcaacctcaatacactagaagttcacctcattagtgagctaagataattgaattgatgtactgccattaatattctttaagttctccaattccctcgctcactgtttctctcagtggttgagtaaatgagatgtaactataacgttgatggcagaagtcacatgaaactcagtgtcatgcattatagcattgcccttatactgaggagtttttcgttccttgcaaattcagctgctcacaaaggttgttctcagtaaagccactgtacagataaagacaatggtcccttcatcacaaattgtgaaagaaaggatattctctttggctactaaatgcccgtttctgtttgtctagtaagtggtgttggttattattatcaagatcactttccagagaaactttgctgaagacctgtccaaattaaggcaaaccatgatgatttggttttttaagggctttttaatatatttataaaatattgacctaatatagaaattacatctgattttctgcaaagttgcattgatagctcatagcccagctctgctcttaccaacatgggcaaatcagttaacttctttgagcttgttttcctgttataaatgatgcaagagtttctgttgctttggtaatgctgtgtaacaatcaatcacaaagcctcactggcatttgacaataagcagttactgctgatgcatctggagtcagtggtgggcccccatgcagctctgttgattttggccaggctggcttgaatttctgggggttggctgatcaaggttggctttggcagaggtgattggaatgactcggctctgcttcatgtgtcctgcttccttcagccggctagcctgtgcatgttctcatggtgatggcagaagttcaagcaagcaagtagaaacatgtgaggtctcctgagacctaggctcaggacaggcataatgtaatatctgcattttgttggccaaagcaagtcacaaggccggtccagatttacagactagggagatagggtctgcatttttttttttttttttttttttgagacaaggtctggctctgtcccccaggctggagtgcagtggtgcgatctcggctcactgcagcctctgcctcccaggctcaagccatcttcccactttagcctgcgagtagctgggactacaggtgtgcgccatgatgcccggctaatttttgtattttttgtagagatggggctttggcgtgttgtccaggctggtcttggactcgtgagcttaagcgatctgcccgccttggcttcccaaagtgttaggattacaggtgtgagccacctgtaactctgcatttttaatgagaggatctgcaaagtcacacagtaaggggtgtggataaatgaaggagtatggcattaaagctgtcagtgctgtgtatcacaaatagggataaaagtatacctccttctttcatttgaggtgagagttaaatgatataatctatgtagaaggcctagcataatacctggtacacaaaaagtgctcagtgaatgtcatctactcttattgctaatattgccatgcctaatgttaataattaagatagaatttataatatcaacttcctggcacagctgtggcaacttctgcatttagattgcctctttttaatttatcatagagtgagggaggtgcctggggggttttgctgtcgctactcctccatacatgcctagtatagtagctttcattggaataaagatccttttcatgttagtgccctggccacattccagaacccaccctatcatttaacgccaagtctggctcatacaagagtctcatgaaattactcatgaaattactcgaggagccaaatataatttctttttcttttttttttttttttgagaccaagtctcgccctgttgcccaggctggagtgcagtggtgcgatcttggctcactgcaagctctgcctcccgggttcacgccattttcccgcctcagcctcccaagtagctgggaccacaggtgcatgccacctcgcctggctaattttttgtatttttagtagagatggggtttcactgtgttagccaggatggtctcgatctcctgacctcgtgatctgccctcctcagcgtcccaaagtgctgggattacaggcatgagccaccatgcccggccatgtaatttctagaataggtccagatttcataaccctctgcaggctaaatcttgttacaacaaatatcatccggtcccaatcgtgacagctcatttatgcaatcttcggtcaagtaacatccagcaaaacaagtaatttagatagctcattgggaattcttttgaaataagtatgaacacttactcttgtccttgtctttgagtgtgctgccacgacgatgacacattggctcacctttcttgtttgttttctccatttctggctagcattgggcagtgttgcctttgccacatattatcagccacagtcttgtcaagcagatctggtcagacctatggaatgtgaagaccctttattagaaattcatttacctaaagaaaacatttatgccttccaacagatctgaatgttggaagtgaccagacatagttacttgctggggagaatttacccacagccaaaggctagactatttgagactgattgacttgtaaatattattctggtttctgatccatcctctcttaaagttggaaagtggaaaacaggaaaagatgagttataaaattagaacacagcctatatgttcatatccagcaaatagaaatataaatatctacctgagtcttatgaatatatacctttagataaaaggacatgagaaactcctcctgtaccaccagaataacccactttatagcaccaaataatttgattttttcttcttttgccaaaatgtttaatagctatgtaacactgctaatcctgacaaactgatatgatttattcactcacttggctgccagaaacctcagcattttctaactatccttagttcttctggtttaaccacatgtcccacttcaatataggtcactttttacttattttgttgccattattttttatcaggagccaatccaagggcatttttataaatagttatagtataagtaattaattaatgaatatttcatatttattggtgcattcatttatttaatgtctgtgtttctagtaaagtgacaattgccagaaagaaaattttaagagtccccctgagattaaagcctatttcttcagggttatccacataaattattaacaacgatttccatttttcacattccaccaatcagtggttacaactcaagaaaacttgccctgttctagagcaatgagaagactggaaacattttaatctcatggtttttttccagatattataacttctaagtatgttaaagaggaaagcctactcaacattatgccttttcgttaagaattttattaacattaaattagtttaaggttaatgcccataatcaaccttactgattttttttctttttcctttcttttctttttcagaactcctagcctataattattcctactagatatgtactatatttttaaaccattccaagctgtttgtcatgtaccatgttgacatcacctatcttagaatggactaggctaacttacagagtcacttgatttccactaaagtttgtgtttggtagtaggctacagtcattctggagacatttgctgtgaaccttgtcccctaatataacgatggattttctattcactgataagttctactcatggattcaggctttgaattactaaatcagagtaggtctctcttttcaaaaatgacttcacctaaaaagggtaccatgcattttttttttccctttttcagctttcatgttgttaaatctcatgatcatatctgcacagcaccatattttctatgagtgagtttgttaatattttctctttatactattggaataactgttatctgttagcatatatgaaagatatttgattcaatttcaactctgctaggtgccaattgaaggtttcaaaaagcataaattgatcagcttgtatttactgagcatctgctatattttagtattaggtatgaatgtgagatatggactcgtgaaaaatcatatcacatgagatatgaaatcataaaactaacaaaattttaaattagcagaatacttttttgtttgcttacatattcatgatctcatttgatctaaatcatggttcctgttctcaaagcttatgggtcttgttagggagaccaaataaatataaatgaaaagacaacaattaaacacacacctatgtattattctgattttaagcctcacaggaactcagagagggaattgaaagtgtgggtttaagtgtttgggattcatgggtatgagataggatttgagttgccttgtgggatttctttattatcagggacaaagctttgaagaaaactacaaccgatcatggggcaaactaatccctccttaaagcaatgttggcatatgtcccttcaaatgtattaatagaaccatcatgactcatttatgcaaagtacagaattcttatgtctatgtgatgggaggaagggtaaggagagggcaagaggagcaggagagataatttataatttgctaagataggagcatctcattaaagtaaagccctggattgaagggtaacaagtgcctatgcatatgtgactcaccaatgtctggtgtctgatgtagaactctatgggcaaaatcctggggtgcaaagaatgaaaaaggaagaacctatttttagataacactggttgaggaagagaactaagaactgcccatagatcaaccaaatgaactgtatttttatagtgtggatccataaaatctgaaatagttgtttttttttttttttttttttttttgagacagagtcttgctctgtcacccaggctcgagtgcagtggggtgatctcagctcactgcaccctccacctcccgggttcaagcgattcttgtgcctcagcctctcgagtagctgagattacagttgcccgccaccatgcctggctaatttttgtatttttagtagagacagggtttcaccatgttggccaggctggtcttgagctcctgacctcaggtgattcgcccacctcggcctcccaaagtgctgggattacaggtgggagccattgcgccctgcccctgaaataaatagatatttaacaaaacgttgctttgcctagagggctcttaccctgaatatggcagattttaccaaaataacacttgagttaatttttatatgttatattttgacctttgactggctctaaataaatatttcctatggataacttcaccttaagacttccactttaagggatttctattaatgttatatgctgcctggttgaggtgtgaggtccaagtttggtgaagaaatactatttctctatttttttcttattttaaaattacagcaggtttttgacttgactgaaggcaatgttattatgtgatgctgtagagtagtctaaagataaaaatcagaagtgttcagtgatttatcttcctagttccagcatgctaaaataattatttctcttatttgcattgacatgtcaaccaatgaaattaatcaccttcaaagattttccttgttcttgaagtctgctggggtagttcaacaccatttcacagaaaatgttatacaataaatctgtaaagtctgccaaaaaaaaaaaaattgagaacctgaggtgggggatggtgtggggagtggaggtgccagagaagacaagggcaaagagcagctgaggctcatgggaaaaaaaaagtgatttacccgcgttttgacaaatgtgagagggccacaaagagtgagttaccgaagtgtggattcagggaagacagaggtggtgggggcaggggaggaggtggaagaaaaggcagaggagggaggaactggcatgtgaataaactatttgtcatttttcactctggcagtgggctgaaatgtttttgcctctttttattttcatttagaatgccaatcaatgggttacagacaaagagctttgaaaaccttttcttatttatttatttagagacggaatcttgctctgtcgcccaggctggagtgctgtggcgcgatcttggctcactgcaacctccgcctcgcgggttcaagcaattatcctgtctcagcctcccaagttgctgaggttacaggcatgtgccaccacacctggctaatttctttttttgtatctagtagagacggggtttcaccatgttggtcaggctggtcttgaactccagacctcaggtgatccaaccgcctcagcctcccaaagtgctgggattacaggcgtgagccactgcacccgccctgaaaaccttttcaaaatgcattaaattttaatgaatttgatagccattttaatgcctgggagatgctggacagggagggtcctatgaaaccaagctgcttagagagaagtatctggaaacactcagccccattttaataatagccacatactccataaaaatacctcaaagagaacaggagcaaaatgaccttaagattcatcataggaatccaaaaattccaaaatttgctgaagatctttttagcttggagagtgcttatttttttgataatttattttaaaacctaataaaatgttttgcttttgtacaccttgtcccaaataaatattttctttggacatattcaactttttattatttattgggtgctttctattattgctacatcctggccagggtattgagagggaaccttttattgtcctctttgtccctatctgtaaatatagtaatccccccttatctgagacagatactttccaagaccccccccaacccccgcccagtggatgagactggggatagtactaaactctatatatactatgtttttcctatgcatatataactatcataaggtttattttataaagtaggcacagtaagagattaacaccaataactaataataaaatagaacagttataatgatatactgtaataaaagttatgtgaatgtggtctctctttctctcaaagtatcttatggtattgaactcatgcatgtacttcctatgatctgtctgataaccaagatagctagcaagtgactattgggtgcgtatatacagggtggagatgctggacaaacgaagggtgattcacatcccgggccagacaggctgggatggcatgaaacttcatcacactaatcagaatggtgtgcaatttaaaatttgtgaattgtttatttctggaattttccatttaatattttcagaacacagttgcccataggtaactgaaactatggaaagcaaaatcgtgaataagggggtactactgtacttctcttcctagtaatatgttcatgctgccaggatgcacatagccatgtgcgaagaaatataattttttagataaacctccctttaagcagaaggtctcaatcctatttcatggagaaaagacccacgtttatactaggactctctcaaccttctacatctaatctttagattcttctgcatgcctgcctatcattttaatcttctctcctctcataagtctgtctcatatctaaggtgaatccttccatatagtctctggatcccatcacctcctttgccctctgagacaccactcatggcttgctttgtcccatattttcagtctcttccttttcgctggatcctttctattggtatttaaacatagtcaaatctctcagcttttcaacaacaacaaaaacagtaggaacagcattagcaagcatatgcatgaaacccaaactccaaaccctcagacccttcccttaaccctacctctacttctctcctatctttgctttttctccttcatagacaaactcaattaatttgtccagacttgctgtcttcgcttcccacacactcttcatcccactagtttggcttctgtccccatccctctttttcttccaattttctcagtcttattgaatgacggtgtttgccaatatctttctgaagcctaggaatgaatctgactctctctacgttcctcactttcccacataaaatgagtcacctgtttccattggtttggtctctaaatctctcctttgagtccacccacttctttccctccccattgcccctccctaatttgggaagatataatttctttttctctgtgaacgtgatgggccagccaatgcatgttgctacatgatgagtccctaaagacttagggccaggtgtggtggctcacgcctgtaatcccagcactttgggagactgaggcgggtggatcacctgagctcggaggttcgagactagcctgggcaatatggtgaaagcccgtctctactaaaaatacacaaaaattagctgggcatggtggtgcatgtctgtgatcccagctacttaggaggctgaggcagaagaatcgcttgaacctgggaggtggaggttacagtgagcagtgagccaagatcatgccactgcactccagcctgggcgacacagtcagactcattctcaaaaaaaaaaaaaaaaaaaaaaaacttaggcatgctgataggcaaaagatctagtccccggagatttccttgtcattttaacatcctcctgatgtgggttttctgtttgaaattgtgacttatgcatctctcagttgattccctttcactccctggcatttctctctgattttgggagggatcctctgttgttactagaggctctgagctctccactgttattttagctctttggtcaggtcctggctctggtcctcattagctgtgtcagcttgagcagatcatagactccttgacccttaatttccttatctgtcaaataaatggtttcccctggtctagtgggtctcagccctgactgcacattagaattacctggggaactttttaaaccctcccaatgcccaggctggacctcagaacaatgatactagcatcccgatgcccacgacgcaggattttttattttatttagaaattttttgtcagtattattttttttttcttttgagactgagtctcgctctgtcacccagactggagtgcagtggtgtaatctcagctcactgtgacctctgcctcccgagttccagtgattctcctgcctcagcctcctgagtagctgggattacaggcgcctgctactacacccagctaattttttgtatttttagtagagacggggtttcaccatgttggccaggctggtctcgaactcctgacctcaagtaatctgcccgcctcagcctcccaaagtgctgggattacaggtatgagcccctgcggccagctctcagtattttttaaagttcctccaaagattctaatgggcagacaaagttaagaaccaccgacttaatgatttttaaaggaccttttgctctttgctcttctagcagtttgtgttttatcccaagttgaagtttctcttcttttaatgtttttaccaagttgggaagaaatagctgtgaagctcccccgacccccttccatctgctgtttgttcttatttacatatgatggaacccagcccactgatttatagctctggttccctcacaactgttattgaactgaaaacatagctgaaaacttattaaacagaaaaaacttattttgagcttcatgctgacaatttattatagaaccaaggaaacatttcaacgtctttccttctagagttaatgttaacaattgatttacaaccccatgctctcaaatgaaaaagttcattctggggccaaacccagtgttttttttttcttgggtgtcccattgagaaagccaaagcatctctgcaggagaactggatttcgaggggtttgtatccatgaacaggcagggcctcctcacattgctgccggtggcctctaatgtgacgtgtcagtagcccctttcctccagtcctctcttctggtccacagacaccggcagcaaagccaggcacgtacatcctcactatgggtgtggcctcactgttcaaatgctttgcgataggtctttcagaagtccacctttcggtagcagccccctttagacctaccattttattttattattatttttttagagacaaggtctcactctgtcacccaggctgaagtatagtggtacagtcatagcttactgcagcctcaaactcctgagctcaagtgatcttcctgcctcagcctcctgagtacctaggactacaggtgcaggcgccaccatgcctggcctttaaaaaataattttgtttttatagagatgaggtcctcttgtgttgcccaggctggtctcgaactcctggcctcaagcaatcctcctgcttcggccttccaaagtcctgagattataggggtgagccactgcccctggcctatacctacccttttaaattggaaataacaagacttttctgagctgccaaggagtagagaggagagtaggaagatgatatagaagagccgaacatttagtttaacccacggaactaaatctggaaagaactggggtcctgacataagtgtgattcatattggtgaagtgtcctttggggtgctaagtctccctgcccgtttctctgtgttaacagttatctctttcaactgttcactttcttctgcaatacctatctgaaatgcacagcccatgcctttcctgtctctctcagtcctttattaaatgattaaaattagttggcaccttgataaggatgaactagtttagtagctacagacaggtaagttattggtttgtcataatctatggtgaattcctatccctgtatacccgtataattcattttatagctgggccaccacattattctcatggaaagaaatggttttttttttttaatgttttttattttttggagacagggtcttgctttgttgcccaggctggagtacagtggtgcagtcatggctcactgcaacctccacctcttgggctcaagcaatcctctcacttcagcctcctgagtagctgggactaaggcatttgcctctacaccaagctaatttttatattttttgtagagatggggttttgccatgttgcccatgttggtcttgaactcctgggctcaagggatctgctcatctcagcctcccaaagtcctgggattacaggcatgagccaccatgcccagctaatttttatatttttggtagagatggggtttcaccatgttgtccgcgctggtctcaaactcctgggctcaagtgatccacctgccttggcctcccaaattgttgggattacaggcatgagccaccatgctgggcctggttagttatcttttagtggtggaaaaaagggaattttcctggaaaaagaagtgttgccagagcatggagtcaagctgaaagaaccccttacttaccatgttgagtaaagagtcatttctcatgcaagccaattttgttccagaaaacctcgactgaagcttcttggctttgacgttccctctttgggtattttcttgtagatggaggaattggttgagggcgttcgctgggcctttattgacatgctagagaaagaaaatgagtggatggatgcaggaacgaaaaggaaagccaaagaaaaggtaaggattccttttgatgaaaaaaaaataagacttctggtttaatggatgttcatgcttgacattgactgtgtagttggtttttatattgactgaactgttgactctgaatgaccccagagttagctgtctgcttttggatgaatacatagatttttgtttcaccaggaggtaagagaaaataatacctgaatttttcgaactgcattttcaaataccttgtaattcggcctttcctttctcctaattgctgtctgtaagaggcacatggcttgctgcctggtgaattgtgtcataaaccatcactggatatggcagaatgcagagcagtggggagtcacagggagcagctggaacaagagcccctaagacaccaaaacgaagaaaacccatattggccacatgtccttctgctctgtgcatgatgcatgcaaatgtcctggggcaaatcctttcctgtaaccaagcatatctccttcccgacccatcatttggcacaaatgacccaaatagtatactgataaactgcagaccagtgttctaccattgcttaggactacaaacgtatttcctaatagaagtggacacttgctgggccttgtaaaattttctgatactatgcgacacgataagggaacaaaggagaaaagtattgacagccatgctgtttaaaagtagaaaacgggctgggtgcagtggctcacgcctgtaataccaggactttgggaggctgaggcaggtggatcacttgaggtcaggagtttgagatcagcctggccaacatggcaaaaccccatctctgctaaaaatacaaaaaaattagtcgggtgtggtggcatgcatctgtagtcccagctactcgggaggctgaggcaggagaatcgcttgagcctgggaggcggaggttgcagtgagttgagatcgtgccactgcactccagcctgggtgacagagcgagactccatctctgaataaatgaatgaatgaatgggatccattttgaattccagagattctgatagagctggaattcaagtgggtggagcatacctgctagactcttgatggatgcttctctgcagctgagcatttcttgtatctagaggtatttttgaaagcttcctgagtataacaatcacctgggttgcctggacgctctggctttctgggccccttcccagcaaggcctgggttaatggatcatggatgcaggctgaacagctgtcactttagccagtctccgggtgattgttatcactaggcaggtctggggaaacactgcctggagtcatactgagtcatactgagcacaaatatttttgcctcagcgttctgggaatgcttaaccttgttgaaatgagaacacgtagagttttagcaaggatattttctagtgctttaaactcatggtactggagatggataaacattgccatagatacttttgtcagtagatgtgaaaaggcgtttgttcagtgtttataatgaaggaagaactgggatggtgggtggcaaggcagcgttggaggaagacaaagagtaggtttgattttttgtttccccttcaaaaatctgtcaaagctgtcctcagtcacataaggcacaggctgatgaaggcaagagcacatgggctgtgatgggaaactctccagatggtagacaactttcaacaccaacatattgttgttttatgaaggcttcatttatttgctgagctagcttgtggtatgtggaacaggatgtgtcttgccctgggcagttgagcgcttagtgtattaagggctctttatcctcgcctgaccccacatgaaccgaagaggtgcttgcatgaattagtacaggaccaccagggtggagggtggggtggagtgtgtgtgtatgtataggtgttgggggtaatgtgttatgaatagctggatgccaggggaatgttctgggaagtgcagtcagttctttgagcagtgtggattgcagttgcctcagggagctcttctgagtggcataagggagtgggtgcctcacagttggcccttctcggcaagtggcccatgggtccttcttgaagcaggactattctcagttcttctaatattagacatgttcctgtttgcctcccgagttgctctccagtcttctattttatttcaatgagagctgtcagtttttcttctaaaagcgttctttgaacactctgctttctttgagctgagttcaacctgccaggaactctgctagttccacgacaggtacaaatatcaaaggcaaattggatctcacaaagttccccgactgtatcttgcatttcagagttcagagaagtttctttaacgaaatgcaagaaagatggatgttgttgaagcaatttcagcagttctttgaagtgggtcctttcctggaccccagaagatgtaaattttttttttttttttcccctcaaaattaaatgaacatgcagttcttaaaatgacctctgggtggagctcgtggtactcacaaagaacactagcggcgttgaaagcttttatgcagctttctactccggcgttgtttttgaaaaaaaaaaaatttcttgccctttttctctgctgtcctcgatttgattgccttttaatagtcaacaagaaaggagagactttgcctaataattccttgaatcttagatggaaatctcccactatcttagggttttgtctttctgatactgagtagcccctgcattaagaaaggatttgcctgcatttgaagtggaggtgaataactcgcctgctcttcctggtatgacttggcactgttctttgggcatgtgttgtatgcagtgtatcacccaggcggaagatttctcatcaataatagtgcccacactgggccaatgctgagtcacttggcaacccattgggaaagctggaaaaatgttctgatttgtgaaagggagaagcttttctttccctcaccatgaagctctggaccgcagctaattacagagcctcctaagaagtgttaacctcagcattccatagtgaccgacctcctgaaccgggcaggtacagaaagctgcagtgttctgaggcctaataccttggcttttgtagcaatgacctcgtctcaaaatggaagtgtgtggatgtggctttgttgtactctttgctaggggtgttcactgtaaaagataaatgaggatgcctctgctcccgtgaagggtaaatttgttttctctgtctccctgccttttcctgctcatctcttaagaggtcacgagtagtttttgtattgtgaaactgatggtgtaggtttcaagtggaaatttagtatcgtgaaataagcaccgctttttgtttaggattctctgttccctgcaagcatgtgctcttattgtaaataagcagcaaaggacagggcatctgttatttttctggtgaccacagctgttgaatgagtgtcaggtgataaaataatgattttaggggtgtcttctggaggatttgcccttgccagagtagaagaggaggatctcaaggtcgctacatcaggattctgactgagacctggcaggagagcgtcagatcaggaggagcaacttcctgagcttggcttatctccagctggatttgactatatagccaaaaagctggatcccttcggaattatttgtttgtttgtgctctttgcccctgggacctaagtttgtcaggtcacatccaaagaaaaatagcaggatgggactcacagggaggtggcatcctaatgatgctctgagggagtggccttaaccttggccacagcaggtgcagagaagtcggctgaatggtcctaaatttattggcatgtgactctcacacacaggctttgagtgaggtggtgagagttttcttgcagagggcgaaacagaggtgtagcccacttctttggctttgtctctaagctctaccaggcctaggtactggacttctcccaggtatgcggtcagggctctgcttatatccggagcctggtggttctcaaggtgtggttccagaccagtagcagcagtggtccctgggaactcattagagatgcaaattttcacatccccacctgctgagctctgggagtagggctcagtgccttgtgttttacctggtgattctgctgcgtgaaaagggttgggaacccctgtcttgtccttaccacttcacagcacacctgcctgacttccaactgcagcctcctgcattttggccaagagcattctctccctgctacagcctgctttgctactcataaagagggcccaaaggacggggaatgaccacaccttcctcagaagtcctcacccaacagttgatgggagttgctgtgtgtggcccccgctccctcatccctctagtgcgtgttccacatgggctctgggagcttttccaatgggctagagctattatactagctaagatactcgttgctgactgcctttctttctctacatatttcctctttctcctaccagtgtttcttttgctgcccaaatgaactgctcgcacttgaatccttgtcttagagtctgtttctgggggattcccaactaggacacagcccctgggggtatacgctttcccagtgcttccttgcctgtaaggcaacagcacatttcaccgagtctggttgctagcactgcttcagcagactcaatgccacaaacatttctagcacaccaacagcatgccaggtgctgagccgggattcggactcagagatgagcagccacagtcccttttctgcgggggccttcaggctcctaggagagaacaggaggccatggatgcagggcagaccaggagaagtgttaggtaacgtgatggagacgaaaggggtcctgggagtctaggggagctcaaacatgacatgtgagggtgccttacttgggaagtgcctactctgcccctttctctcttcctctgtggtgttcccacaccctgtcttgcagccttgtggcaagtcttcctcttccttccttactaatcccaactctgcatctggctgtcacttccccttgataccttcactcctgcttcacctcactgtgcattttaaattgtttcgtaggagaaaagaaacagaagggctttcatcaaactgtctcctgccctttccagttacagattctagcacatttgcataaccgctcaagaatgcagtcaccctgcgtctggcatccactccagggctcaccagggacagtgactggtagaccagcatggaaaccgcgggctgtggctccctcccatgtgccaccttcccgagcttgtcccttctctttggctctatgtctctctcacacacatgcaggccaagatggcggccttcatacttgtatctctttcctctcactggcctcaacaggaagtatggtatagaggtcaggagtatagacaggtgagagactgcctagtttccaagccaacttctacaccttattgactgtatgaccctttggaaattacttaacttcttccaccctcagttttcacatccataaactggggagattggtccctgtctcagaagatttgttatgaggattaaaagagccactgtgcctaaagtacttataagaatgcctggagcatgagaaaggctccccaagttgtcagccgtttggtccaaactgctgtgcctctgggaggggaggctttggctggaccagacggtgagaggagggatatttgtgagcagcccctgctgagagggtgttggaggggatgcatttcttttctctggattttggattttgtggttttgaacaaattcagtattgtcgttgtgatatatattttaaacacaaaagtaaatatctggtataagtgggagtttgatgcatatatctatttattttttcgagttaaagtctcgctctgttgcccaggctggagtgcagtgttacaatcatagctcactgcagcctgaaactcctgggctcaagcgatccacccaccttagcctcctgagtatctggaactataggtgtgtgcccccacccaccttagccttctgagtacctggaactataggtgtgtgcccccacatccagctaagtggttttcttaatttttttttttttttttggtagagatgggatctcactgtgttgcccaggctggtctcaaactcttggcctcaaccgatccgccagctacagcctcccaaaatgctgggattacagtgtgagccactgccacacccagccaacatatatttattaaaggcatagtacatgtgatatcttaccggagtgattttccatgctctagagcctcatgtaaatgtcatttagggggatgctttaggtcattcattctcacacttgagcatgcatcagtgccatctgaagggcttgttaaaacaccaattgccagccccacccctagaatttctgattcagtagtgctaaggtggagcctggatatttgcatttctgacaagttctcaggcaattctgatgctgctggtctggggcctgtgctttgagagctctaggtgattacaagtgaaaatgtccttatgccaagcctgtgttaatagaagggtataatgttcattaagtgattgtcttacctcttactggagtccccttttcaccatttctcgcaggtgggtcccctgagtgagtactaggacacccagaacccagccaggccacctactctactgttgctgtctctgctaaagagccctgcttgagagagatccaaaggctctttcttggtcatttctgctccttgactccacatctgtccccaggaactacccaggttaagtcttccacataaaagcccttccaacgtttgaagatgtttaaatgtttttcttttttctttattttattttatttatttatttttttcgagacagagtcttgctctgtggcccagactagagtgcagtggtgcaatcttggctcactgcaacccctgcctcccgggttcaagtgattctcctgtctcagcctcccgagtagctgggaccacaggcatgcgccaccatgcccggctaatttttgtatttttagtagagatggggttttgctatgttggccgggctggtcttgagttcctgacctcaagtgatccgcctgcctcagcctcccaaagtgctgggattacaggcatgagccaccgtgcctggctgttttttctatttcaaataaaacacctttagtgtttctcacattaaattaaccaacattacagtcagactggatgttctaaatgcttcacaaatattagctctctcaatgccataatatccgtatgaggtaggtactttttttttttttttaatacagatgaggaaactgaagcacagagagtgtgagcacacttacccaaggtcacacagctagtaggtagaagagctgggattccctccctagaggtctggtttcacagtctgtgcttttatccgcaatgccagtgggtctcaaagtgtggtccccagtccagaagcatcgccatcactcaggactagctaaaaatgcagattcttggctctatcccacatctatagaatcagcaactctgggagaggccctaggcatctgtactttaatcagtcctgctggtgattctgatgcagcccaagtatgagaaccattgctctaaggtgtggttctgatgcctcatcctgctggctgctctccagttttcaatatcttttttagaagcttaagttcaaggctgtgcacaatattctaggtatagtgtaactcacacagcacaatgggaatattattactgcctttgtcttgcatacaaattatattaagaaatccaaagtttacattatggctatcttttcccctcagccattcactgttggctcataacgaatttctagtcagttaatttctaggtctttttttccccgctcacaggaactgttgttaagccctgttgctccagtcctaaacttggcattaaaaaacaaacaaaaaaaaaaaccctcatcccagaacttcacatttattcttattaaaatccatttagttgttttggttcatggctctggctttcaaaaagtatatttctggacctcctacatgtttattattgttttaaaaatctatgctcatttaaaaaatctggaaaataaagcacaacagtagaaagacaaaaaaaagttctagttccatcatctaaacataactgctgctaacattttgatgtatcactttgacttttttcccatacataggctttgaaaggcattcttgaacaatgatgtttataaaaatttgagttcttttttctcttaacatttattataagcatttcttgtattattgcatattctttatgcaagaatattcactgttggctgggcacagtggcccacacttgtaatcccagcactttgggaggccgaggcgggtggatcgctagaggtcaggagtttgagaccagcctggccaacatggtgaaaccctgtctctactaaaaatacaaaaaattagccgggtgtggtggcaggcgcctgtaatcccagctacttgggaggctgaagcaggagaatcgcttgaacccggaaggcggaggttgcagtgagccaagattacgccgctgcactccagcctgggcgacagagtgagattctatctctcacacacacaaaaagaatattcactactatgacatattcttctagtggtggcacaggaggtactacttaaacatttctctatagttgcatgtttaggttgtgctgttatagttattactatgatacacatcttttgcataatgccttctccctaaatgtaggactaattccttagaatggcatctcagacaacctttgaaaaggtcaactctttccttcagtatatcaactactgtttctatgtcgttcataacttgataagtttgttttttagttttattattttggggttattatgaatggacatgctcaaaaaaagggaattggaatcagccaatttgttcatcctttggcaatgcccttccagatttatctattgaacaaaaatattcagggagaaacttctaagtggtgagtcttttgttaggtgccagtcaattcactaactaatagatttttggtctagttgttctactttggacaaactccatggaactatgatttaaattctcccttttgcctgcaaggagaccttgagatatttagcaatgcgttgatatcatccagttatactgtatttagggcattctttaatttaccaatgtattgttctgtttaaaatgtggaaacctgaggaaatgaacaaagcttcactgggttctcatttttctgaagttccatgttacctaagtgcagattatatcattctgtgaaaacagccagctgttcaggcaaccaaatcagaaatctcagtctttcctcttagccaacttgtaagcacaaatcgtgttgcttctttctgccagctctcaaatttataccatttctgttttagttattcccctcccttagcttctcatccttaaacattttttttaattgaggtaaaattcacctaacataaaactaaccattttaaagtgaacaattctcaattagatagaagaaataagctctcatgctcaatagcagattatagtgactacagttagcaacagtatattgtatattccaaagcggctagaagaaaggacttgaaatgttaccaacacatagaaataatgaatattcacagtgatgggcactccaaataccctgacttgatcattacacattctatgcaggtaaaaactactcacatgtacccataaatatgtacaaatattatgcatcaataaaagaaaagaaatgaagtgagcaattcagtggcacttagaacattcacagtgttgtgtgatcaccacctctatccagttccaaaacatttttgtaactcccaaaggacactttgtacccattaagcagtcactctccattccccactcccccagctcctgacaactaccaatctgctttttgtttctatggattcatgtattttggatatttcctgtgaatgagatcacgcaccaatgcgatttttgtgactggcttctttcacttagccttatgttttcgagactcatccactttgtagcatgtatcttctcattctgtttaattggcgtccccattgatagtcttggaaaaggaatagcaaaataaacccctgtagcatttctgatagtgagatctttcctgtcttctctgaactttttgcaatagcatcgtagtgtttattcatagctgaaatactatcccccagctatatattactgaattgaagcaactcctgtagggaaagaagtatgtctgactactttatttttgtattttcagaacctaatgtggatctgacactccattctttgaccactgggcagaacttagtaagaaccatggctttaccaaacactagctatgggacctcaggcaagatgggcagttttgggggtctcagtttcctcactcatgaaatggggacaaatacttttgtccctatttttactgagtggaacaattaatatatgtgcagtggctagcacagagtaagtgctcagtattagtaagatgacatgttcatttttttttcccaagtttcctctaactgcctccctcactaaataacatgctccattatagtgtcttaaaattgggaatgaaaaagtgatgccagttacataattacattgttttctttggggcagaggtacaaaatagaattttattaaactttgcctctaatatttaaaaatatttttatggaaatttaaaaatgtacgcaaaaatgtacataactaatctccgtatacttatcacccagactcaacagttagtaatattttatcatgctgatttcatctactcccctacttgtttttatgcttgagaattttaaagctaattccatctatgaaatcattttactatgattccatctctgacaccattttactataaatatttcattatgtatctccaacatataaggaattttaaaaacctaactataataccattaacatacttgacaatattaacattaattccttattagtatcctgtctgtgtgcagtttcctataattatctcaaaattgtttgctttcttttttttgaaaaaaaaaaaatggttgatttgaatcagtatccagatgaggtctgcatattgcagtcaataggtacatcttttaaagctttttaaattttaagagtaccgcctctccatccatgaaatttatttatgaaataaattgagtcatttgtctggtagaatttttaacaatcttgttttgctagttatttcttaatgttgtcttttaacatgttgttctgtctcttacattttctgtaattggttctatctagaggtttgattagattcaggttcaattttctttggataagaagacttcataggcagtgctgtgagcttcctgttgcatctatcaagaggctcacaatgccacgttgtcccacttgcaaagcgaagggcgatccgtgtgttcaggtgttgtcagcctgatcctttcatttgaactttcttaccattcctcatgcagcagtcctgtttcttggctgtacattagaatcacctgggaagctttttaaaaatcctgaggctcaggccacaccccatatgaagatcagactctctgggagtgggacacaggcattttctaaagttacccaggaggggcccggcgcagaggcttacgcctgtaaacgcatcactttgggaggccgaggtgggtagatcacttgaggtcaggagtttgagaccagaccagcctggccgacatggtgaaaccccatctttactaaaagtacaaaaattagccaggcatggtgtcatgcacgtgtaatcccagctacttgggaggctaagacaggagaattgctcgaatccaggaggtggaggttgcagtgagccaagatcatgccactgcactccagcctgggtgatagagcaagactctgtctcaaaaaaaaaaaaaaaaagttacccaggagatacaaatgtgcagccaggcttgaaaccactgacttaattgtttcagtggccattgataatatttcattgattcgtgattccattcggtgttgcaatgtttgattttcaaattctatcattctttttgcatttattagctaggctgtttttataaaaaaggattttccctcatcaaccacttgattactctgacatatagtttatacaggaaagacagcataaatggctatctttctcttgattaattttcacaagttggtgccctaagcacttccagaggtgccaaaatagttttctttttagtatcaccaacttagggaatcttatgtatttgatgtgtttaaatttgttatgatcatcattcactgaagctcagattgtcccatcttggccaatgtggggctcttcctttagtgaattttgacatgaccctagttgtttttgaaagcatctttgcctcctggcacaagatattctctttaatgtttaacctctatttaatcataagctgttttgaacaatttgtaaatcagtgcctaaattagttctcccaccaatgaacagtatattgatttttttctgatggggaaagggtagcaccttactaacttgaaatacagcattttattaatgagcaaatttgcagaaatatctgttagagactgatgtaaattatcttttgtaaggggcagtagcttatatcaatagaaacacacgtaatatgtactccatggtttttgaaaacctctgcagtgttgcattttcagtgttgatcatcaagaatacaaatatataaccatgtcatacattttaaaaacaaataatgctagtgttgaggaatataactaatttcaaatttgtggaacagtgggactatattaaaagatgagtctgggtgtggtggctcacatctgtaatctcagcactttaggaggctgaggcaggcggatcacttgaggccagaagtttgagaccagcctggccaacgtggcgaaatcccatctctactaaaaatacaaaaattagctggacgtgttggcacgcacctgtaatcccagctatttgggaggctgaggcaggagaatcgcttgaacccaggaggcagaggttgcagtgagccaagattgtgccactgcactccagcctgggcaagagagtgagactctgtctccaaaaaataaataaataaaataaaattaattaattaattaattaaaaaaataaaagacgaaacttggaatagtaaatacttaaaaattctaacaatatcaacaggtagtgatagtttaaacatgtactgtaaaagtgtttggtttttaagggtatgtaagagactggttgtctgtgggactttgaaagcagttgggaaatgccacaatagcctcagtataaaattctagagacccaaagcggagagagatgcctcttaagaattatggaggatatttattacttttattcatgggatgggtggtggtgatttaatgcctgtctcttgtttcttttgtttttttttgttatccaaatccaaatccaaattatatgaggaattcacttaaaaatatacgtttagtttggtttaataaaaataatcagttttgatgtattgacttttaatttcatgggggaaagagtccattaggaatgttcaggctttctgtgtatattttgtgttgctcattctctttggcccaagatgaaactaatagccacaatgtgtctgctttggtgctgtctctagggttgtgtctgctgctgtcagctgcacccttgttatctggctgctggtcctgctcagtcagttgtacaggaatgtcatttccattaataaccccagggccggacaggcagatagtggaaaatgggtgaagagagagaaattgtatttaacccagtgttctgagttgtcatttttgagaccctagcatagctgggtaaaggcaagcagagggcatgacagcaaatctatttctggcagaatctcatatacaaactggagaaacagcctgataccaagagaagaaagggtgaaatatactgggaaaagagggaaagatttggggttggaaaagtcagaggaaacaatgttaggaagaaataacatgatcaagtattctgatagaggtgctgacaactttgcaaaataaatttaattttgattgtaaatgccatcatttgtggtggttcaaatgaacaaaattcctttttaaaaaatgaaatttatgtaaggattgctcatagaagattttggagttttgtgctatgtttttttttttttggttctggatcagtgaaaggcccgaggaacagagtaggttttatttttttttccatctaggtagaatgactcagttactgtagttgtctgtgttttggttatttattgctgcataacaaattaccccaaaacttgctggcttaaaacaagtattttattatttcctatgattctgtgggttggctgggctcagctgggtggctcctctgctggtttcacctggagtcccttaggcagttgcagtcagatggtggctgtggctggacgtccaaggtggcttcttcacacatgtgtctggcacctcagtgttcctcatgtggctttctcaacagggtgctgtggtactcctacagggtagctaagagtgccaagaagagaaagcagaagctgccggtcctcttaatgtctgttctcagaagtctcagaatataattgacaaataataattgtatatatatttttggggtacagtgtgatgttttgatgtatgtatacattatagaaagattcaatcaaactacttaacatatccatcacttcacaaacttatttttttggtaagaacattaaaaatctattattttagcaattttgaaatatataataaattattattaactgtggccaccatgcagtacaattggttactaaaacttattcttccagtctaattgaaattttgtgccctttaatcaaaatctcccctttccctatctctccccctccctccagcctttggtaactactttctactctctgtttctatgagaacaactttttaagattccacatataagtgagattatacagtatttttctttctgtgttttgcttacttagcattttttttctatttttctgtttggttgattaggctatttttcattattgactgaattatttttttctgtttagctcaagaccattgtatacatcgactcacagaagtatttgagtaagcctaatcattgttgaactgtgatggggaaaggattcagccttgggacacgtgacctttgtgtacaggtgtaagaaattcctactaggttttagggcccagaactggactaggccatgagggacccaacccatcctagtaggcaaatcattttccagttttatatttgagttcattagtaaataagtttactttccattatagacaccccctccactgacttatggggtcctgtacgccataaccaaagactcagtgttggaaaggtgatgctccactctgtgtctttgtttagctaaggtgaaggggacaggtctgccaccctggtatattctggtattctctcattggcagtcttagtgaaggctcatgagagcttcctcacagaggtttgtaaggattagaactgagtggaatagacctgttccagggcagagtgaagccgaggacaacagtgagattgtgtccttcagggccacagaccagaacctttactcaactctgatgttaagctataaagctagtttacaagtttatggaacaattcagcttgttcttccaggctcttgaaaatgaaggttaaggctgggcccgtggctcatgcctgtaatcctgtaatcccagcactttgggaggccaaggcgggtggatcacttgaggtcaggagttcgagaccagcctggccaacatggcaaaaccctgtctctactaaaaatacaaaaattagccaggcgtggtggtgcctgcctgtaattccagctactcgggaggctgaggcaggagaatcgcttgaacctgggaggcggaggttgcagtgagccgagatcatgccattgcactccagcctgggcgacaagagcgagactccgtctcaaaaaagaaaatgaaggttaagttttggcaaagtgatttgtatagatctgtaatacatcatgttctaatgaggtccaatgagttctaagtaatttctgatttccattaaaaatgattcatgaaaaaataagaatctcatcagagagagagagagaccacttttgaaatgaggaaaaatgacagaatagaaaaggagaaagtctcttttctctcttcttccccaagcccccctcatcactggttacttatttgagcatcctttatcagcatctaatgagaatgagaacatagtgggatgccatgtgaccttttgagtaggaattggaagctcttatgaagtttccagcctgatgtcacttcagatccaggtcattaatatttaaaaaaataaaaaaaataaaaactcttaggtgattcgaatgagcagccaagtttgagaagcagagccctactggagcaatgcttctgcaacttgaatgtacatgcaaatctcctggggacttggttaaaaatgcagattcttaataagtttggaggggagcctgagagtctgcatttctaacaagctcccaatggaggccgatgctgctggacaatggcctatggaccatactttgagaatatagagcagggggcagcaaacttttcacatatgaaggcctgagagtaaatatattgggctttgcaggtcatgtggtctctgttgcagcaacccaaatatacctgtagtacagagcagcaataggcaataggcaaacaaatgggtgtggctgcgtgccaataaaactttatttacaacaccaggcagtatcctgaatttgtcttacaggccgtgagccaataaaactttatttataacaccaggcagtatcctgaatttattttacaggctgtgacttgccaacttggtctagagctttccctgtctcaagtttttgagccgtatcttgcttcttccctgttttgttgggctgaatcttaggtaagaattaaatggttttgaaagaggttactcaatggctttgttgaactgatgaataattgatgatgacatttaggctctgtttacaaacagccccaattgtcccttggttgtggctcattgctttgccttgaatataggtggcctttctgatttctctccctagactgcctcttcagcaatggatcgaaacagagctagggtttattctaaaatgtggcccacgggcatctcagaataaataaccaggtctgaactgtagaggcagagggtggcttcaggtcacttttccttgacctgcattttacaactcatctctggtgttttgtctaaggcgacagaggctggtattttggctatctgagaggtagagagcagagaggttcctggacatgtacattttgtgttgagataggtcatgccccagatatggctattaatggtagcagagagttaaatgttgctgataatatattctaataagtagataatacagaaccaagttgtcagagttttggggggacccaaatttggaaccaaggactcaaagctcagaagggttccatcttgtgggcttcaggagtaaggtgcaagattcctggtctgctgctcatggtaaatttcctgcatttcaaaccccaaagtcagttaggcctaagcttcaggaaagttttcagtttaattggttcaaaactgaaacagactctcatctatctttatgacagtgctaggattcctaagggagaggtgttactcctcttctgaaatgggaggatgtgggccaggaatccttgggccagggatgcttatggcagactccatttctcagcatggttttggctgggaatttcctctatgagattgacccttctctccccgaggtgccattttctggaataccaccttctctctgctggtaaaatctaatttaccttagtgccttgactggtctgcaaaataaatgttctgacgtttcctgacaggagagcctgtcctctctgctttctgcttctttatcattcttgtactttcttgccttgccttttccattttgatcttctctcttggccaagtcttgtcttccgggggctctcagtcaaagtttagtcccaccgatgtccagaacagaaagctcagtggtattatttttagagagggagggagaacctcttaaaagcatacttaaaattctatctgtgtgtgtcttttcatccttacatctgagaatattatttgtcttggcatgttgaatatggttactaatgcagatgtggtctgtgccttacatgttattcagtttgatttataaaaaatgaataattatataatagaatatttaatcactcagaagataatatatgttgggaaaacatgaaatttgaagtcagattaaggctaaattaatctaggtgagaagttggttttggccctcattgcctgtgtagacttggggtgagttgcgctcattttctgagtcttagcttatgagctgtgaaatggggatgatctgtacctaccttgtacagttagggtaggatttggatctgatgatgaagtaaagtacttagcacagtacctggtttatagtaagggtttaatggagagcattacttttgttatttaaaaaattatgtctattgtttctgtttctgtttagctctgagatctcctcctctttgaaaatgtcctttccacaaggcccttcccttcccatccattccatctgaccctctaccttcttctgttgttttttctcttacatcgcattctctccctatgaccaactatgaactcctgaaggaaagaaatccagtttattaaactgtgtgtcttcactccgtctaaacacaacaacatggacaaatttcacagatgtgttgttgagtggaagaagccagatacaaaagagtacacactttttttgaagttcaagaacaggaaaaagtaatttatggagacagagatcaggatagcggttcttttgaaggtggaagggttattcactggggaggtacccaggggagtcttcaggatgctataaatgttttaaatcttgtctcaggcctactaacacagatgtgtgtatgttttaaaaaatatttgattggtatacttagtatttgtgcactttgtacgatatagtgcagtaaaaattttaaaagatgtttcccagtatgcagggcttatttgccttttagtgatcattcagtaaaaggttgaatatttaatggatgtcatgatgaagtaaatgatcaacttttttttttttttttgagacagggtcttgctctgtcacctaggctggagtgcagtggcaccatcatagctcactgcagcctcaatctcctgggctcaagagatagtcctgcctcagcttcctgagtaattgggactataggcatgcaccacaatgccaaactaatttatttttttgtaaagatggtgtctccctatgttgcccaggctggtctcgaactcctgggctcaagcccccaccttggcctcccaaaatgctgagattacagctgtgagccaccgtacctggccctaagtggttaatcttaatcaccatgtgaccaagaccaaattttaaggaagatgtagcatacattttggaaaacatggtagacataattcataatttatagccagaattcacgctgttgttcatggcgctacttggatcttcacatagctgtttcagaaaatatagtaaatgcgaacggcaggacttgcaatttcagacagtttgtgcagttggcaggacagagaacacagagtggggatacggtcctgtcagattggtggaaaacctcatttttaattgattgtctattgcatctatgcccctcttttcccaccctccctttgtccttttatcaattctacttggaaataaaatctgcaactctaatagatgctactgacactcgtgcagcaattctaccagatggcattcgaatctcgggtgttctatgaaaaatgaaaagaccaaacacatgcacaaataaatgaaggttgaattaatctttataattaaacggaatattaccctgctatgactgatttttgctttcaaactggattgcgtgctaatttttcagtgaactgtaattgtattaacatggcttttttgatgcctgaaagtacttaaaaatagattttgcgaagttactgagagaaaagttattagaacttttaatctaaacatctctaagatcctgaggtatatttatatcacgacttacagctgcaaagcattttccaatagttttttattctttgtcccttatcatcctgggatttaggtggcactggccagaaattgggttgaattgcaagtacctgaggcacgttagaaaattgatgtcctactgtgtacccacaaaaattaaaaataaaaattagaaaacaaatatgtacaactgctatgtacccacaaaaattaaaaattaaaaaaatgagtgggagggaaggtggtagagttttctacataaagtgcacctactagcttagtagtggtgactattagtgaaatccctaaggattattgaagcagaggatgagtcccctacttatgaactgataacacagtgttgggggttctcagaagtgggtccagaagccttggtaccatggcaagtaccatgatctacagcagagagtatctcaaatttcagcaggcatgagactcccctatagtagtggttttcaacccagagtgatgttacacacctggagacatttggcaatgtctggagatatttttgatcacaactggggggacagagggtgttactggcatttagtgggtagcagccaggaatgctgctaaatatcctacaatccacagaacagtccccagagataagaatgattctttcccaaatgtcaatagtgccaaggttgagaaaccctgccttatggtaaggctcattataatgcagattcctgggtcccagttcagaagcattctaactcaagagatgtagcattgtcccacaaatttgtgttttcaacaagctcccacgtgacacagatgctgccagtccaaagacaaagctttgggaagccctaagctagacgatgccagtgtcaaaggaacaagccatatatgtgggcactggccctatgacattcccttcttttagaaaaatgatatgaaaattcccacttgcattgattgattgattgagacggggtctcgctccgttgcccaggctcgagtgcagtggcatgatatcggctcactgcaacctccgcctcccgcatttaagcaattcgcctgcctcagcctcccacgtagctgggattacaggcacacgccaccatgcctagctaatttttgtatttttagtagagacgaggtttcaccatattggtcgggctagtttcaaacttctgaccgcaggcaatccacccgcctcgacctcccaaagtgctgggattacaggcgtgagccatcgtgcccagcccacacttgtctaatttaataattcaccaaagttatctcatttgatctctccccaccagtttatgagggaggtacttcacaaggtttttaggtggtaaagaattgttcatataagagctaaccttaaaggaaagaatgacaacaattcccacttaaactgttgatgagacaaggggatatgtttatctaggttaatctccaacttgcctcctgtttaaataagtaatttaacaactggaggaggattaagtagctgattaaatttctctgagaaacgttaggtgttagggccttggtatttattgcaggtgtgtttctaagccctttcaaccttgatatttgaaaatgtttttaaataatttgtaagtattttttcccattccccaaaaaatgcattgatttatttcatagtatttattcccattttggttaatatttctatactggctgtgttttaaatgtagatatttacctcaacaaaatatgaatattacagctaattatagaattatttaaatagttattatttaattatatatttctatcttgatgaaactttccgaaaagattaacctttgtgccttatttttcccttgctatctttactattggttttgaaaaatggggaaacctcttgtgtagaagaggggttggcaaaccatttctgtaaagagacaaatggtaaacatcttaggcattgtgtgggctatatggcttctgttgcaactactcaaactccactgctgtagcatgaaagtggcagtaaacaatacttaaatgaacgtggctgtcgtcagagagaaaaaagcaacttttcctttaccactttaggtttaatgtcagggcctgtgaattaaactataaaagatggattaacaagagaaaagcaaagtttattcactaacctgcatgagagcttacagaaaacacagcccagagaaacagaattggggggttacatattgtcttaagaaggggtagggttaggattttaagggacaataaatggtgggaaatgactgagaaatatatgaggggacctaacagaaagtcaggcttgctttagtaaggtctgtttatgtaagttctcatcctggcgccaactttttatccccggtgagaggagttattttcccccggtgcaagaagtgtctcttaaaagggggatttacgacagttgaattcttttggaagtctctgcttgtaggccgataagggaagcatggagaaagcctctttctgcttgtcttgattctcagataccttcagctcaaaatagtcctttgctacagtagcatattccggaccaataaaactttctttacaaaaaaacatgtggtaggctggcttgggctgtagtttgctgacctctgatacagagccctgtgagtgagacagagacaaacataatttattttggctcatataaaagcctaagtgtgatataggattgttcccactcttgggctgttatcattttggttatgtctggataaatgggcttagctaattgaggcttagggtattcatttgactaggtctagcagctgttctatttgcaaactttgtgagcagtttaaccacatataatcgaaaccaataaaaacattgatttaaaaatttatgatttggccactcttctgcccagtttcttttcatctttttttttttaatttaatttttatcatttgggacagggtctcactctgttgcccaggctggagtgcagtggcacaatcttggctcactgcaacctctgcctcccaagttcaagtgatccttctgcctcggcctcccaggtagctgggatttcaggtgcaagccaccacgcccagctaatttttgtatttttagtagagacagggttttaccatgttggccaggctggtctggaactcctgacctcaagtgatacacctgcctgagcctcccaaagtgctggaataacaggtgtgagccacggtgcccagctcctgcccagttttaaaggaaataaatgagccgggtgtggtggctcacacctgccatcccagcactttgagaggcagaggtgagcggattgcttgagtccaggagtttgagacaagcctggacaacacggtgaaaccctgtctatattaaacaaacaaacaaataagggaaataaatgagagttgcctctatttttaaggtaatattgctaccactctaaggacgatgggtgtgttgttttattaattaatcataaggtggctttggcttctaaaatctattgctactacctgctccatctgtttaccaagaaaactcaaatattactttctttctttaactctgttcagtacagggctcacccaagtaagaggagcatcacaaagacaccagggaaatgtttagtgccagtatggcaaaattaagatttacttctgccagagtagtttccttttgcagacagaagaaactgcccacctccaaaatatattgagttggtgttttaggagagagcatggatggtgcttgtttataatttggaacatgccttcctagaatgttgtctatcttagagagtaatgagggttttctgctatactggggcattattcacatggggttgagggtggatgacctgaaatctgatctttcctgtcttttacttcttgtacaattagaactgtgatttgcacttagagagccttctgattcatggaagtgcttatctatcttctacccctgtatgatgcatctgcttgtggaccgcacccaaaagcaatttgcagaattaaagtttttgaagactcataataaatcagttcaattttatcaagagaataaaatttgattcatcagataactgcattgttattatttgtgggatcctgatagacccagaggatattaaagcctgttcccctgactaattttcatcaataccattagctccgcttagggtaatatcttcagctaaggcatctatactagtcaatcatttgtttggcattatggaaactgccattgttttgaatgatagtgtaattcatgtacagtctcctgaacttctgggtgcttaaagctcagaattttgattgatgtttaatagttattacagaactcatcagagaaaatgaggccttggcatgattgagcctgactgaagctttcaaagccactgcaagcttaggaaagttgccctataaattttttatgaaagggcagtgatcagttgttccatttttttcttaagttggttaaattaataaaaaagaaaaaatatgctgagacttaaccacgtatactaaacatacagctatttaattaagtgattaaagtggtctctttgatgtgatacatgcaagacatttgagaatttatctgactctcctaaatagccaagtcagtggggattaaaataaatgagctttctgtcttcctttctgtagatcagcttaatagtaagtggctttgaaaattcaggagtaaagcagtcaacctagccaatctttaaatcagttcagtcacatatataaaaagtagatgccatttcagagctcacagctaaataaagcagaattatgcctgattctgttcttcccaccagcattatcaagttgtagtatacagtattgaaaattctgggaaggtgggggtgatttgagagtttaaatcatgttgtatattaggttttcaatgttcctcatttttctgagttcatttgtgatagctgttgtttctctcttcaaataataatctttacaaactctctgttgtctccatggaaattaattgtgatttttaaagctctagcactaagactttagggcagggagtcaactcccaagcaactgagatctgtcgcatgtaaatggtagtaatagcaaagagcaaagcaaaaacaaataaaaatcttgatagctaagccgtgcgtgcacgtgcacacacatgcacacagatgatgctgttgagcatggatcagtttggaagcattgttaagcacttactgtgtactagcccctgtgtcatgaattgaggcaactcagcgaataacctagctttatttaattatctgtgttggcttagtaagttatggcccttgggccatatttggcattctgcctgtttttgtgtgaaccacaagttatgaatggatttcacattttttaaatagttttaaaaaatcagcttggcacaatggctcatgcctggaaccccagtacttagggagggagatgtgggaggattgcttgagcccaggagtttgagacctgtctgggcaacgtagtgagacctcgttctccacaaaaaggaaaacaacaacaacaacaacaacaacacaaaaggacaaaaaaacacaccaagtgtaaacaaccaaaagaagaatatattatgatacatgaaagttgtatgagattcaaatttcagtgtctataaagttttattggaacagagtcacagccattcatttatgtgttgttctagcttgtttctgctttctcaggtacaatcacagagctgagtagttgtgcagaggccatatggattgcaaagcctaaaatatttactatttggcactttacagaaaaagtttggttattcctgatatgggtaaggcaaacttcataattcctttattatctgaatacttctcccaactctctattttactttattggtattagaactaaatgtatccatattctacagacgaggaacctgaggaacagagagattcagaaaattcagctattgctaataccttatgtgatgatgataacttgttatagaatggttttcctcagctttttaaataaaaatgcagttaagtaatcgataatattacgtttgtatgttctttcagcattaaggagagtcctgagccttgattttatgttcagtatgtgtattagtctgttctcatgctgctaataaagacatacctgggactgggtaatttataaagaaagaggtttagttgactcacagttccacatggctggggaggcctcacaatcatggcggaaggcaaaggaagagcaaagtcatatcttgcatagcggcaggcaagcaagagaaagcatgtgcaggctgggcacagtgtctcacgcctgtaatcccagcactttgggaggctgaggcaggtggatcacctgaggtcaggagttcgagaccagcctggccaatatggtaaaaccccatctccactaaaaatacaaaaaattagctggacatggtgtgggcacctgacatcccagctacttgggacgctgaggcaggagaatcacttgaacccaggaggtggaggttgcagtgagctgagattgtggcattgcacttcagcctgggcaacaagagtgaaactccgtctcaaaaaaaaaaaaaaaagaaaagaaaaaagaaagcaagcatgtgcagaggaactccccttcataaaaccatcagatctcctgagacttactcactatcaagagaacagcacaggaaagacccaccctcatgaatcaattacctcccactgggtctctcccatgacgtgggaattatgggagctacaatttgagatttgggtggggatacagccaaaacatatcagtaagtatttgctgattgattgaaatagcttacataaaatatatagttttgtttgccaccaagaattaattgcattggaagctgagtgtggtggctcacacctgtaatcccagcactttgggaggctgaggtggacatatcatttgaggtcaggagttcgagaccagcctggccaacatgatgaaactccgtctctactaaaaaatacaaaaattagccgggaatggtggtgcatgcctgtaatcccagctactcggtgggaggctgaagcagaagatgcttgaacccgagaggtggaggttgcagtgggctgagattgtgccactacactccaacctggttgacagagcgaggctccacctcaaaaaaaaaaattaattgcaatggattttatatcttgcttaattttccagaatgttttatatgttctcacaaaatatctcattttctccccttttttctctcctgtggtaagatcagttaatattgaaatataccttaatgttagctgggcatggtggcacacgcctgtgatcccagctacttggtaggctgaggcacaagaattacttgaacctgggacatggaggttgcaatgagccgagatcgtgctactgcactccagcctggatgacaccgtgagactgtctcaagacaacaacaacaaaacccagggaaacgtaccttggtgtgaacagcactgaatgatgtttatgattgtatgttaatcctcttatatttaaaggttaaatgtaaaatatagccttttatattttctgatactcttgatgacattgatcatagtgggtttatcaaattattcattatatgaattaatatttattgagtattggtcacttgctatgttacctgtggtaacatggtgattaggtggaataggctattggtttaatttgaatagtattagaagattctctcagctacaaaacctctcatttaattgtatttattcctttggctaataaactactcttttaaataaaagtatttctccagagtaaatatattagattgctattagtgacttacattctattataaactagtttgaggccccagtggcagctagtggattagcaaccttgaagaattaataattttgatggatgagaagggaagggggagatatctttggagcacagagtattgctaaggaaaggccaactagggtacgatggtattgcaagtggtatgaacacataggacctgctaggtgttgaaaggaacagataagagaaagagaaagaggaggaaggcagaaaccaagatggcaagtgctaaaagcaacctgtatctttgatcttttctagggttagatttggtagtgtttcttgtgtctgttttcagaggtgtgccaatagtggctctcaaaagagtcctccaacttttggggggctgcaaatagcctggattcttttgactcatatgcagagtctggctttgctaggaaaatctcctaccatgctccaagaagcttgtacatttgtcttccattgataagagggttgcctcaatagcttttctccctaagcatttcttttctcgatatttttcctctcaccacaagtgtggccttctgaaactggacctatgactaaaagagtgacattatttctcaggggtttcaggtgtttggttaggggtataagatgacctggactcttctggaagacctccaaacactacacatcacagttactccaaatccttggaaaaagtcacgtttctactttcttggtgtagtctacaactaacatttgctcatcatgtactctggaccaagggaaaaaagtgttttacatgcaatgtcatcctgaactcttgcagacaatgctatgaaataggtactaatttttagtaatttttttctcaacatctgatgtaaaggagagtgtgttaggattacattagctaatggaaaacatgacacataatgcctcaaacaaataagggctttattttctgtatgtcatgaagggaaaagagggaggcagtccaggtctaatatgctggccttcgaatgccatcagcttttcatcccaccatcttcagcatgtagattttttcctcatatgtgttgccttgtgattactagatggctgctcggcttctggcattgcatcagcattccagaaaggaagaagaggaaaggctaaagcagtagttctcagctggaggtgattttgccaccaggggcacatttggcaatatatggagatatttttggttgtcacaacttgcggaggggggcatgggttgctcctggtatctaatttgtagaagccaaagatgctgctaaacatcctacaatttataggacaaaccccagagcaagaattatctggcccaaagtgttgagaaaccctggactcgaggcagaaagcatatgctgatgaatctgtccccttttaaaatggatcattggaagtgcaacaagaagtttttcttaaatgtcattggcccgaatctcatcctgtagctgactccagttggaaaggaagctgggcaacacagctattttgttgttgttgttgttgttgttgttgagtccattgtcatcctgagcagaattggagtcctgacagtaagagaagaaagggagaatagttattaggtagacagtaggcggtgtttatttcaaaaagttaagtactctgcctaaggtcacagaggtagtgaagatcagcagctgcgtaaacctcctctattgaggaacggatgtccagctgtcaagtgcagcttctctctacatgtctgtatgaataaagcatgaaaatgcatgcactgggtatggaaagccctggagtttttgatcagccacaaacagcctaggaaatatttcttgcaggatataatatgcaatctgttaaatatttatatcactgctctctcagcatttacagtgggacttgcctttcctttttgtccatgtaaccaatagggtaattaatctcagacctgactcactaatactttgcccttcaagccatcaaactattggtgcttcacttctcccattttgaaaaattaaaaagtgatgtgattactatttgccttacttagggttcattcaggaaaccagacactcttctaagtatatcaaccagcaagacatttaatacagggaattggaggcttaggtaacctttcagagggctggggagtgaagggcagagtctgtcaatgatctctgctgcttgtacaccaaagaggtctttctcaggagaatgcctggaagttgctggaaaagggctgtatctgctgtctgcagatgcccacatatctgtataaggctaccaacagcaaatgaatggcatctcctcttctacctttggaattgcctatgagtgcttctcattggcagtctaacctggagccatgggatattgcaagatgtatttctgaagcttctcagggaaaaatgtagaatggggtggggtaggatgaggaggaattgacaacgaagtctgtggcagaaaaaaacatttgaatctgaatagaggaatacatatatagcatattttaggaagaagaacactctcttcagatgttggcaatgttgctactagtattattaccttattctaggtatgtatctttgggaggtaaatagggattctttgtatgtgttctgattatcttcaagtcatgatgatgctcaataaataataaaaaaggattcaataacctgcatagatggtgcagaaggtaatatattctgtgaggctctgtagtgcagtgggggtcccagagatgaggtttaaaaaacaatgcataattcaccagcatgctctggaaagaccagtcttcagaaaacaattgtggatgactcagcttgtccgttcgttcgttcttttcttttcttcttttcttttctctctctctctttttctcactttctctccaaaactatctggaattctttacttgctatagttatgcatatgacttatagcgagctgataaaatatagtgcaaaattaaatacaatgccggaaataatagaataatctcagaatgaggtaacctatagatgtatgacatagtttggtgttgggggtagagttgtaacctctagttatctgctatctgggtcacatcaagcttttagtgtgtgtaactcacagagttttgaaggtgtaatttgatctgtgctatacttgagtctgtgaaacagcaaaacccattatgactatgtcctacagcccttgtaaaatcctaagtcttgagcttcaggattctgctgatatttaatatctgaattatttcaaggaaggtaaggaaagtgtactatcttactatgtttatttcttgagtgaggaaaattgaaagggactaaaggaaagaactcgttgccaagagcagtgtccagaggtcactggttttgctttgtggctttgctggaataaaaccaacgtgtttggggttgcctaggtcttatgttgggtcatctggaggcagatctggagatgagaattcctgtgtaagtgattcattaaacaaatactcccaagagaaatcagtaagggaatgggagaagcaagacagggagggatgagagtccaatttcaggagacatctcagaactagtctgatcctgcagggaactttggaagtacaaattatacctcagagtttgtcctgaattgaggcaagggggctgggctttcatattgccgcttagggctgcttgggtggaggcagaggcggaggcggaggtgcaggtgcaggaaaagtgggtagaaggcaaataaacccccaggaactagctatttttgattgcaggcaaggagctctagtagttcctagggcaggccttcagaaagtctcaggtgttggccattagaaaagaaaaaacatagatgctggagggatgtacagaagttataaaagggatcccagggaatctggtcagagccctgacagtgtacttgtaagcttctcttttgcttttatgaaacccagaatctggagaagggagagagaaattttcacatggaactgtaaagtttctctaaagcaagggttgacgaactttttctagaaagggccagataaaatatttgaggctttgtgggccacagggtgtctgacccaattattcaactctacaactgtactgcagaagcagccatagttgacaggtaaacaaatgagtgtggctatgttccaataaaactttatttataaaaacaggggtagggtggctggatttggcccagggaccatattttgccaatcgctgctcttgaggttctttatatgtgcctaagtttgtttttcctttatttattccctatctgttataaaacacagaggataattagtacctttgtctatctaaatgatggttatgacattatgatgtatcttaaattattctagatcactgcctccaatctttctggcatcctggccatctttcacaatgttgcaaagataatcttcctgaagcatgactcatctccttttattcccatgctaaacatatttagctctctcttagctgtaaaataaaatataggcttgttaacatggcattcaggaatccctgtgatctgaccccaggccaattttcctgcattattttctgttctccatcctcatgtacttatagtccagctacattaaattactcgccctctctccaatatgccatatcgtgtgtgtttgctatctccttgtagtttttttcatttttatgtatttaaactgactatatactgtcaaaattttatatatatatatatgatgtacaacatgatgttttgatacatgtatacattagaaaatgggtaaattaacatatccatcacctcatatatttatcatttttgtggtaagaacatttaaaatctactcccttagccattttctagtgtacaatacattgatattaactatagtcactatgttgtacaatacatctcctaaacttattcctcttatctaactgaaattttgtatcttttgaccaactccctaaccccattcccccacccctggtaaccaccatcctactgtactctgttatgagtttgactgctttaaatttcgcatgaatgagatcatgcagtatttgccttttggtgcctggcttatttcacttagcatgaagtcctacagattcatccacgttgtcacaaatgacaggattttcttcttttttaaagctgaatagtattccattgtgtatatatactacattttatattccattgtgtacatatactacatttttaatccattcctctgttaatagacatttaggttaattccatatcttggctattttgaatagtgcttcaatgaacatggaggcactctctttagcgtactgatttcatttcctttggatatatccccagaagtaggattactgctttgtatggtagttacatttttaatttttagaggaacctccatagtgtttttcatagtgactgtaccaaattatattgccaccaacagtgctcaagagttcccttttctccacacccttaccaacacttgttatctcttgtcttgttgatagtcgccattctaactggtgataggtaatatctcattgtgtttttaatttttatttccctgatgagtaatgatgtggatcattaaaaaaatctgttgacaatttgcatgtcttcttttgagaaatgtattttcacgttattttccctttttaattttttaatttctttttttttttttttttggagacagggtcttgttctgtcacccaggctggagtgcagtagtgtgatcatagttcactgcagcctctacctcccaggctcaagtgatcctcctgcctcaacctcccaagtaattggaactataggcaggtgccaccatgcccggctttttttaaaatttatttttgtagagacagggtcccgctgtgttgcccaggctggtcttgaattcctggcctcaagcaatcctcctgcctcagcctcccaaagctctgggattacaggcatgaacaactgtgcccgacctcctttccccattttttaaccaggtgatttgctttcttgatattgagttgagttttaaatatattttggatattaaccctttatcagatgtatggtttgcacatatttttgcctctgtctttgcccctgtttcttctcctggaatgttcttctagctctacattttgaaatcctaaccattctcttaagactcgattcagtcaccttctccattaagcattttctccatgcagaaacagtctctcctctggactttgataacaatattgtctatttctattaaattttttattttgtttacattgtactagacagttatttgctacattcactgcatttttagtatactgaggtctctcaatatatatctatatatttttgcccttcacagtggcttgcatatagtagatattcagtaaatggagttttcagatgaagggcgcatttctacatcttgtgattattaatgatttaagtgctgaaactctgacattatttttctttttcctttttgtaggcgagagctgttttggcaaaagttggctatccagagtttataatgaatgatactcatgttaatgaagacctcaaagctgtaagtgctaaatttactgtacttttttttttctggcaagttttactggccttgtgcctttcaactaacccaagtcctagcaattaaaactggtgatgccagaaaacaccaacttttgattaattccttggctagatatgagcctgaatatgccaggcagatcacaagatttagggcagattcaaaataaagaagtgtcagaaacgatgcgtagctgagtgggtaccaaaaaacaaatggacttgggtttggcctaatttgatcataaaagaaagaattaagcaaattgagtatgttacaattagtgggcatgttctaatggcaaatgcatcatgtttgttgttaaatactttttatttgcttcattcgtattaaatgaatagtaataaatctgcctgctgggagttaacttcattaaactttatgagtgttttggcaaattaaatgcatatacatacgactctataatttattgtgaattggattgtgtatttgcagtaagttactgatgaaaaatggtcataattcttttttatttcaatatttttggacatgtattttccagtaggtgtattaattacaggcctttctattcacaagcactgttatttcctctcctacaaatagttctgataagtgatttttcttcctcatttaaaaaaacctgtttttactattcactagattttcttgaaaatgtagtcttttgaaattctttaagtaactatagttctgaggtatagctctttcctgaaattgtggttcaacaagtggcatatctgaaaacgatcccagctttgtagatgagcatcaaaattttacaagactattcaaaagtgagagaaagcattaattagaatcttcctccattgggctctaagatatagcctcccaaaatattgatacagttgctctggaagaaaataatgatgcctcatagcatcctaaaactcagtctatcttattatacactgttttgatgatgctgaaaatcccattattattatcgtaactaaaaatattgaagcacttgacatattcatgtacattatcttttaattccttcagtgattctgtgaaatagatgatgttcattcccattttgcagaaaaggacatagagactcaataatttaagtgagctcctcagttccacacagactttcagagccaggactgatatctgggctcaggaagctctgcctgtaatcagacaagggattcttgagggtcctttttaggcagctatgctggaggaacagaggcatcagggtggagacttggtgggggcagtgtgaccagggctgttggaagaagagcagagggaaggccatgttatcaaatggttaagagcacaggctccagtatcatgggcctgggtttgaattctgcttcttgtacttactagttatttcatcctgtgtaggttacttaacttcggttagcctccctttggttatctggctactggaaatataataaccaagtcttagtattgttgggaagattagatgagactgtataaatgtaaaagcacttggcataatactctggctcagagtatagcctacttcctataaagggtagctttgcggatcaatatggaccatttgtggtccattttcaaatcagccatataaaatattccatttcattgatccttaatagaaatagactcaagcgtgaatttctaccaattttggaaatatatctgtatcagccaggaaagcaaaaagcacagtaggtattttaaacagggaatttaatacaggaaatgggttggaaggcaagaaaagggaaaatagataaaccacaggttaaactgctgttgctactaagaagagtatcatcagggcacaaagtaccttagcaggagaacctgggtaactccatactattggtatatattctgagtcagcatgtggatgagaaggtttgagagacagtttgatgtagaggttataaatagggaccgtggagtcaaagtgcctggagtaaaacccccagtctaccatgtaccaccttgttacctagggtaggttatgtatcctctctgtgcctttcttcatctgaagaatgaaggtcataccaatccctcccatataggatttctgggaggatcaaataagttaacatatttgaagtgtttagaatgaaccctaacatacaatcagcacaatacatgtgttagctatgacatcctcaattcacacttgtggtagtgaactattttggtttgaaaaagtcctcatgaattaactcatgcactgtccaggtccctcaaattgatttaaaagggtatacagatggagcagtctcaagctttaatcgaataaggtagaacttaaggcttactcacaatatttagttgatcaagttttgttggcattctgttgctaagttcagagccccaaatttaaggacccattgaatgcaatatcttttgtgaaaagaaaccagatgccaaacaggatgccatgttggctgtgcttctttgtttctctggggcctgaactgaagacattacacaccaagatttttaatcacttctttgaagaaatggctttcatctgactcattgccaaagcagacacaattacgcccaagagttttaacagtttaaaaacctgacagtgaaaaaaattccaggtacatgaagtaaaaagacatttgtattcagaaaccgattgttttagtcaatttacacggtgctataaagaaatacccgagactggataatttatagaggaaagaggtttaattgactcacagttccacacggctggggaggcctcaggaaacctacaatcatggcggaaagtgaaggggaaacaggcaccttcttcacaaggcggcaggagggaagagtgagagttcaggaaaaaactgccacttttaaaaccatcagatctcatgagaactcactatcacaagaacagcatgggggaaactgcccccatgattcaatcacctccctcccttgacatatggggattacaagtccctcccttgacacgtggggattacaattcgagatgagatttgtgctctctcactttctctccccctcaagccccgcccttttctttttctgacagtgacttcagtccctcctccaaacctcagctctggagtggcaggcagttctcctctactctcctaagtgatggtaccatcacctcctcccttctgtgaccctagacacaggagtcgcagctgtgtactcctgtgactctcacagagccaaatcatatcactgatagagaaaatgaataaaacccaccctaaaaataggtaaaggatgatatgatagattgtaatattgtcactgagggcaatagcaaaaagactgaagtattcctggtacacaatgagactgttttcagttttaagaaacatgtagataaggactgctataggacctatgagaaatttctggtaatacgagctctgagcatgagaggctgttacaaatgaaaaacagcatgctgcatttgagacaggtggagatatgattcatcaggcacaaatgcaaaaggaaagaggagcgagattacctgatggatcagacgaaggtcaaggagaaatgttgaaaattgaagttgggctcatgtggaaataaaagcaaatgagatagaattaagaggtaaatatgcaaaggaatcagaaattttttaaggatgacaaggtaaactgaggtactcagcaaagcatttccgaacaacaatcttgtagtttttgaaaagaacaggaagaaataaaatgccctttatttgaacccccatcaacatgcaggaaagcctgttagcctaaaaaggtaggcatgagcccattttcaaatcagcctaataaagtattccatttcattgattcttaatagaaatagattcaaaagtgagtctctcccaattttggaaatatttcagtattagccaggaaagcaaaaagcacactaggtattttaaacaaggaatttaatacatgaaatatgttggaaggcaagaagagggaaaaatgagataaaccacagattagtaactttagaaagcagctgcgactcctgtgtctagggtcacagaagggaggaggtgatggtaccgtcacttaggagagtagaggagaactgccactccagagctgagctttgcaggaggaactaaagattcttccagagttattgtcagaaaaagaaaagggagggagtagagggggagagagagtgagagacagcaacacagcacccttttcccttctgcaacccactaatttcctgtagtgcctcctatttgcaggaagctaattggcaaaggagcttgagaaacagttttcagattcccagtccccagcattacggaacagagtgaaagggtaggcatgtagctgaaaaactacaggtaaataactggcactattaaggacgttactaaggaccaaagtcagaatcatggctggcctccatttacttaggagaattggaaatgagaaaattttcagaggccaaagtttctggtgagtgatacacacatatatagacataaatgtgcatatagggatatgcagatatgtgaacctatgtaagattctctgtggtgggtctggtctactttggccagtgaaacactagtgtgtgtgtgtagtgtgtgtgtgtgtgtgtgtgtacatgacagagagtgccactctgcaagagtgaggtgatattcagatggaatgctagaatgctgcagaaaaagaggttgttaaaatattaaaataattctttactatttgttaaaaaacacaaaacattgcgctcagctctttcaagggacccctggccatcatggcactggagagctaagggtgggcattggaggtgggacaccctggtgccccccaaccttccagccaggcctctgtaactctctcacattggccttcatccagactgttccactggtcagagcagaccaagaccagccccagtgtggagatgggacatctggttccagtgctagtgtgctggctggaactccctcagacccaccttcacatagctgtttgtaggaattgcatcctccatggtacactgtatatgtggattattaaacattttgagcatcacctcagtatatattaggttggtgcaaaagtaattgtggtttttgccattactattaatgccaaaaactgcaattacttttgcaccaacataataagtatgtctacatgtatagacacacattacttttgggcaaagccatctaaacacaccaatcttgcatgttgctttgttgtttgaataaggggacatgtagatataaaatacggattccattaagtattcagaaaatcctttgggtgcctaacataaagtctttctaatagatatttggatatatctctgagtatctttaaatggatttaaattaaatgaaaggtatcctagaatttacacttcctactggcacagtaaggaaagtaccacaattagtgcttcagtatttttcatctgcctattcctacatgtaggccgaagactatactacagatcatttgcattcctatgtactgccttataaacatgtacttatcctacagagaagctgaacacatttccttgttctgcgcttattacaggttctccatctttggggtggtggtggtggtaataactttattcttccatttagtctgtggatctgggataggatattcaagaagagaaatgtaggctctcctgaattttatgatcgggacagctgttcctgggaaatgacacaagaatcccaattaattccccaaaggtcacgcaattgaaaagtcaagagatggaattgattgaaagtgatcatcaacttgacctagactttttccagtaactgaaaggacaagaggcttttgagccaagtattgtctcttgccaaatttaattttttcattttggagattacaagcggctttaaaatattcatgcgaattcattcttgtttctacttctagaaaaaatagaactttctcaatagttgctgggtttcaattctttttctcatccaagggccttttgaaatatttaaaattatcaaaatattattacaattagcaagtcttctaaaagtaaaaactgatcccactgatattattttttaaaagttaatatttttgaaggaaattcttctgagaaaatttcccagaaagtgttctgagcccaagaacatatctgaattttctatcagttataatcatattctgaaggttttggcagaaaatttgggaactagagaaaacgcactcataatattgctacataatatatacttctgttacagtttattaatttgtttttctctatttctgtactgccgtaattgatgtttacatataatttggtacaccaacctttacagtaacatattgttttgctactgtctttatagcctttgttaccatgattttaactgctgtatagtatttcaagtaagttgtatcatgattgatttaatcactgcttctactcccttcctcaatctcactttgtccttgaatcactggttctcttattaagaccaacgaaaataacattggagtcagagccaaatgacttggacggtgtagctttgccaaattccgtaatctccttagccctgtttcccatctatcatatgtgaataacagtgactggcccctgcctacccccaaacacttaacctgtctcaaggaaaaacgtaagacctgtcctctattacttgtgatttccattaaataaatggaatagatcaattaaaccaggctaagaaagaagaaatattctcaacttaataatgaaaacaatttttaaattatctttctaaacataaataagctatggcaaattgtaattaattacctctgagttttgtttcccccaattattttcagggttctggtaggtccttacttatctaatgtatttttagacttgggacccttttcttctttacaacgttttttttttttttaatttttaggcagagtctccctctgttgcccaggctggagtgcagtggcacaatctcggctcactgcaacctccacctcccaagttcaagtgattctcctgcctcagcctcccgagtagctgggattacaggcatgtgccaccacacctggttaattttcatatttttagaagagacgggatttcaccatgttggccaggctggcctcgaactcctgacctcaagttatctgccagcctcggcctcccaaagtgttgggattacaggcatgagtcactgtgcccagccctttagaaagttttgagatggctttctgtttaatgtctgtagaccaacctgaatatcaagggatttttttttttcagatggaacagtaatgaaagtatcacaattagcaagttttctaaaagtaaaaactgaccccactgatattatttttaaaaagttaatatttttgaaggaaattcctctgagagaatttcccagaatgtgttctgaacccaagaacatacctgaattttctatcagttataatcatattctgaaggttttggcagagctgtcttggaaacaaaagctgaaaaaggcaaagggttgaacagtggacacatcttttaaccatatgatctgggaatgccttaggattgctagtaaggttgctttctataacaaggtgcttactctgtttcttctgaggctaaaagaaaacctttatcttaaaatataatcaattataagattttggccagcgcggtggcccacacctgtaatcccagcactttgggaggccaaggtgggcggatcacttgagtccaggaattcaaggccagcctggccaacatggcaagaccgcatctctactaaaaatataaaaattagctgggcatggtggtgcatgtctgtaatcccagctactcgggaggctgaggcacaagaatcgcatgaacctgggaggtagaggttgcagtgagctgagattgcactgctgcactctagcctgggtgacagagcgagactgtctcaaaaaaaaaaaaaaaaaaatatatatatatatatatatatatgtatgtatatatgatttctttttattatgaagcatttcaaatgttggaacatgagtaaaataatttgaacacatctattttaacacatagtaaacatattgccatattagctttgtacatgcacacacacattttaaatgaacagatgcatttgaaattttgtctgtaatcttccttgatctaatctccttcctctgcgtctatctccatctctgcatataaacactaccttgagttcagtcttattattgttattcccatgcctttctttatgcttttgctacataggtacgcatccatcaacagcatacagtgttgttttgcatgtttaaaaactttaaatttcctcatagatacaacttaccttattcactctgcataatttttaagattatttcatgttcatgcatacagaacaatcatgtaaactgttgtattgccttccattatgtgaatataccacaatttgtttatcagcccctcttccctgagcaagcagtttgagggacaatttaaagtcatagtgttataatttgttggccaagcagaacacagagggtgccaggaatcaatacttttatttctgcctttctccatgtgccttcagttattttactccttcctttatattttggcttggtctcctggaaagattgttaagatgactccttaacaaaaacttctccacggacatgagaacccactctgtgttagggaggagctaaatgtgagccagacattggtcaacaagtaggtgactgtcgagcctattaccatcaaattgcatatatacattcgtatctataatgtaatgccttgtgggtttcatatacacgagtattttactttttgcttttaaaagactattaaagttataaaaattacagtttataagaatttggttacccttggttatctccttattcaaatgtgtatttttcttaatttccatagtaatatatttaaaaacccaagcattggaggtcactacaaacgattgcatgaacagctccacagatcttatttacaataaatagctaggttaggtattgctagttttgtagatggagtgcctatagaatggaaaccgtctgccattctccttccaaaacaaggaaaggaactaaaaaagcaattatgtctgtttccttgtcttaatagacaacattgttgtgagctgctaccagctttctgtgttcccatgcaagctataatctatgatttgcctctgtaatttcattaatatttagtgaccagagactttttgagtgttaacagatacattctgttaataattattctggtgacttcattgtgcttatggtggaaaataggtctctgaatcacatttattgttttcctttacgaacaactaccaattatttgactaaatcattgtctataagctaaatgagttttcagccaactaaactgcatgttactgaaaaaacttacgtgacaaattaacaaagtacacattttaaaaaagatcaaggactcgtgagccaagaaatttcaaaccaaagataatatggtttataaaggttgaagtagatttttcaattagaaagtaaatggaacgcattgtaaatgactgcagcttctcttgttgtgtttttactgtgatccagaaatgactatattgatttttgaagtttttacgttaacaaaatcactgagactaaatttcatggctttgtgacttctgggtcaactgataacagctgagagaggctgtgactgatgcagcttctctgctagttgctccttcctatgctgaagtatttttttagagccatcttttatctttacttagaacaatgatgttgtggtttgttttattcagatcaagttttcagaagccgactactttggcaacgtcctacaaactcgcaagtatttagcacagtctgatttcttctggctaagaaaagccgttccaaaaacagagtgagtattaaacaaaaaaagttaaatagataaatacattggtgagaagcggagtctctttagattaaactttgtaattcccctcaagtcagagtagctggcttgccagttaacttgttttagcaaaatctgtgtcatgttttgccaactcttattttttatattacgtgattcagatcttaagtctaattacaggtcccccatttctagcatcaacacatatcaagagaaggcttattagaatgcaaacattaaagttatgtctagatctagttatgaatatatagagagggaataatttctctggatttttacattcatgtaataacttttgaagaccttaaaaaagaataaatacttaaactatgattagaaatgtcaaagtaaatgtatagaagcaactagaaaatatttgttgaggtaatgcctatcaaagaactgatagctatattgtttttatctaatagcagttatgatttatttgccttcctctcagctgcctataggagtttttcctacagataggagagtttccttaggaacttttaggcccagagcccaccagctacgatttcatcccttagcaaaatgtcagtgatgaatgtagcagctaacaattattatttgtttacattgtaccagaaagtgctttacaatttttaattcattttatcctcatacgaattctgtgtggtataggtactgttatccccattttacaggaaaataaaaggcttacaactgagaaattcttcagcttaggtttggatcacattttgttctgtctgctggtgcttttgattcctgggactggattctgttctgctaaggcccacttctccaatgcttttttttctctctgttctccagattggataatttctattggtctggatttcaactccagaatttctttttttaatttaattgtattattatttttttaacttattttttatttcaatagattttgggggaacagatggtggttggttacatgaataagttctttagtggtgatttctgagatttcagtgcacccatcacacgagcagtgtacatgtatactgtatcagtgtgtagtcttttattcctcacccccctcccactctttccccctaagtctctaaagtccactgtatcattcttatgcctttgtgtcctcatagcttagctccctcttatgagtaagaacatacaatgtgtggttttccattcctaagttacataggataatggtctccaattccatccaggttgctgtgaatgccattatttcattcctttttatggctgacaacttcggaatttccgtttgttttttgtagtttctatttctctgttgtgattctttgttaagtcattgtcatcatattttctattaattcttcaaataaagtttattttaattctttgaagtcatctataatagtcactttcaagtctttgctaaatctaatatgtgggctcaaactaactagagttagtttctattgattgcctttttattaaattaattaatttttttttacagtttttcctttgcttaacattttttgttgttgttgctaatgacagtttagatagcatgttgtagcaactctggattctgatttatttttctgaggctttttttttttaaaatcaaaagtaactgtcctaacttatactgccgaatagatcttctctgtggtatgtagctgtcgatgtctccactcagttttttaactcttatttgtagttattagcctcacttcctgctggttgtccctgtgtctacatagcttagtgctcaatcagtgattaggtcagagcttgtgcttaaacaccttgagtccatagggcttctaccctctgccagttgctctgtgtgtgggttgggagcaccttcaaagttatagccagttctcagtccaccttcaatttcaccttccaccaggccctcactggtcttccctgcacatgtgcctagtttcccagtcagccagggatgtgtggagtgcttatttggcccttctattactatttcagttataggatctctcttttaaatttctgactgggttttcctcgttagttttctactaagttggccattcaaaaattaaaaaaaaaatgttgtgggtatgtagtaggtgtacgtatttatgaggtacatgagatatttcaatacaggcataaaatgtgtaataatcacatcagagtaaatggggtatccatagcctcaagcatttatcctttctttatgttacagacaatccaattatacagttttagttatttttaaatctataaaaagttgttgactgcagtcaccctgttatgctatcaaatagatcttattcattctatctaagtatatttttgtacccattaaccatcccctcgacccagtacccttctcagcctcattctactctctatctccatgggttcaattgttttcatttttagctcccacaaataagtgagaacatgtgaagttttctttctggggctggcttatttcacttagtattgtctagtttcatccatgtagttgtaaatgacaggatttcattcttttttatggcttaattgtactccattgtatatatataccacattttctttatccatttgtctgttgatgaacacataggttgcttccaaatcttggctattgtgaacagttctacaataaacacgggagtgcagatgttccttcgatgtactgattttctttcttttaggtatatacccagcagtgggattggtggactgtaaggtagctctatttttagttgttcgaggatcctccaaactgttctccatagtggttgtactaatttacattcccagtaacaaagtacaagggttctcttttctcaacaacctcaccagaatttgtttttgcctgtcttttgaataaaagccattttaactggggtaagatgatatctcattgtaatttttgatttgcatttctctgataatcattcatgttgtgcaccttttcatatacctgtttgccttttgtatgccttcatttgagaaatgtctattcagatctttgtgtctatgtgtctgtttttatgccaatatcatgccattttggttactatagctctgtagtataatttgaagttaagtaatgtgattcttccagttttgttgtttttgctcaggataacattggctattctggatcttttgtggttccatataaattttaggaatttttttctatttctttgaagaatgtcattgatattttgatggggattacagtgaatctgtagattgcttttggtagtatgggcgttttcacagtattgattcttctaatccattaacatggagtatctacttttttgtgtcctcttcaatttctcgcatcaatgtttttatagttttcattgtggagacctttcacttctttagttaagtttattcctaggtattttattttattcgtagctattgtaaatgagattatcttcttgacttcttttacagatcgctttctcttagaatatagaaatgctactgatatttgtatgttgattttgtatcctgtaactttactcagtttatcattttaatagtttttttggtagaacctttaggtttttccaaatataagatcatattgtctacaaacaagggtaatttgacttctttctttctaatttggatgccccttatttccttctgttgtctgattgctctagctaggacttctagtactatgttgaataatagtggtaaaagtggacatccttgtcttgtctagatcttagaggaaaggctttcagtttttccccattcagtgtgatactaactgtggctctgtcatatatgactattactgtgtttaggtatattccttctatatccggtttttcgagagtttttatcctgaaacgatgttgaattttattaaatgcttctttagcatcagtttacatgatcatatgccccgtgtttctttccactgtgataggacagcactgagttccagtgcaaagtcccacaatcaccgtactctccttcccccaagcgcagaggtttttctctctgtgcccatgtggctgctgctggggaatgagggaaggacggtataggcaattcaagactggctttcctaccctcttcagtgcctctttccttgatgtgatgttaaaaccaggtattgtgattgttcacctggattttggttcttatgaagatgctttgtgtgtgtgtgtgtgtgtgtgtgtgtgtggctagttgttcaatttggtgttcctgcagggaggacacttgctggaggtttctacagccttcttgctctgcttcatcctctatgttggccatttttatctgacaaagctgtggcttttcactgccacccccagttgagtctacccactggggcagcaaagctgctgatttcccagccagcctttttctgacaaaactaaggtctcactgagctaggagggacaggagtagtctcaggcaaaaaggccatagtgcctgctctacttaatgccaagttctagcagtttttaaatattaaattttgtttaatttattgctcccccttgatgaattcccagattcctaaaatggttatttgttgacaatgttgtccagttttgtacttggtttttgtagaaatgatttgtcaaccttctcatgccattatacctgcaagcctggcttccatggattacaattttttttttcatggcccactttttaaccttggctaatattctgatttctagatctttgactggctgtttttatgctgcctagtcttttgctactctccctttcaagtccctgttctgtcctggcttctagaaactctgagcccctgtgctttcccttggcttaagtggtgattaccacttctccctcttatgtttccatccggccatccctgctctctgcccttcaaaccttcctataatatgcacctgaaaaattcattggaggttactgactttaagaggtaggcctaaagctgaatctctcccctacctaaccctgactccagtcaaaagcacaaaggaaaacagctttagaactgctttgaaaaatgatagataatggtttaaagccatttgctccactgtctttggttctttcctctcatcacgttatttctcagtccacctatcctgtttcattcccagtctaaattattcaatagttttagatttaggcttcttaaatccaatactcaaatctgatgactttggcaaatgatttccagtatccctatgaccatctacatgtaatacggtagtcacagatctatataatcttgcccttcaatatttgcttcagatcagttccaactcttttttaaaaaaaaaaatctgtggaaaattgaagggtttcaccaattttttggtgaattttcagggtcttctcaggggctcctgcatattggcaatacagtcagtctaattgtttgatttcaaaatgtcattattcatttagttgtgtagaaaggcctggattagtaattgaaaaactcctaaatgtgttatctttaacatcgtcctaggatactgatgaactttcagattctaatggtcttaactatttctaatattttattcatgccttagaaatatactggctttgcaggcttaggcaaactgagatttgtgtggttttcttttctgtcattgaaaaacaaatagctctttcacaagggtattaaattggttaacttttgggaaaagttctccagaaatggaaatcagtgcaatgcttgtaattcttgtttcctcagactatatgtctatttcagggaaataacatttagaaatttaaggtcttctttgcatagtaaagggatatgagtaaattccttttccttcttgttttttttttttaaaggaaacatctggctggaccttttcaggcattgtagagacttttagcctcatgatactcattggcttgaatggacatctttcaggtctgaaaattcatgagttaatcgagtggggatcattctggagtagctctactacactagtttactttgaacagcatcatgattatattttcacaaagccctgaaataacgttttgcttctttgtgggtgtaggagataaagaccctttatcttttattctcatggaatccattttagctgcactaatgtgcattaagaagtttctaaggcgatgggaaatgtcagcaagaatgaaattaattgggtggtcatccctgaaggtacatatttaggggttggttcacagaattgtcacttcatcagcttgcttaaaaatagaggatttacttactgctcggcttgagttgaaagtaatttctttccctcaggatcaccttctttgacagaaattattttagcccgcctcacttttaactcactctcattctactgagaccaaacacgtctgaattctctatcttttgaaaaatatgtaaaaatgcattaaatgtctttataaattatgttcctgcccagaacttttgtttgcaaaagcattatctatagcatggaatgtgagtgatataatctgcaggatattaataagaaagcaataaatacactattgcttttccattccatattccctagactatctgtaggagttgataagaaaaatgtaaaactttagcctgatgtatatctattttatatggtccaaagaaataggtgtaccaatgtctttttcttcagattcttgtattttggtattatattccttttatgtatctcattctccagtataatttcatccccattattgtgggatttgaaatttctatgagacctctccttaccttatccaccaaatcctttctcaaacacagactgcagaagcaccctaaagacatagtaagaagaatttaaagcacttgaatgatattctctgtttattgaagtggatgtatacatgcaataaattcattttaatggatttagtgatcttctgttcagcacttaccatttggacaacagtcaaagcccataagcaacttaaaatcttgttgggacataagctgtgcaaactcagatgccttcaggggccagtcagttaacaaatggttgacctacatgggtgtaaacaacagggagtggtagggactgtagaaaactagtaattacacacaccacttgaaggaattccaattcaatagtttgttaagccattgtgttgggcaagcaaaacagttttctgggaagattcagcccattgggttggacttagtctgtggatagccaacttttcagcattccatttatctattgctgtgtgataaacctcccccaaatttagagtactgaaacaacagtcattatttttctctctcatggttctgggggtcactaggctcagctgcatggttctcgtttgtggtttttttttttttttttggacacagagtctcactctgtcaccaggctggagtacattggcgtgatctcggctcactgcaacctccgtctcccaggttcaagcgattctcctgcctcagcctcctgagtagctgagattacaggtgcccgccaccacgctgagctaatttttgtagttttagtacagacagcatttcaccatgttggccaggctggtttcgaactcctgacttcaggtgatctgcccacctcagcctcccaaagtgctgggattacaggcatgagccactgcacctgaccatttgtggtctttcatgtagttacagtcagatagtggctggggctagagtcatatggaaggctacctctctcacatgtctaatggttgatgctgactgttgactagaacatctacatatggcctcttcatgtatgttgggtttccttacagcatgttgattgatatagaaagttcaaagagcagcttttctgagaaagaagaagggagggagggtgtgtttgtatgcatcagggggaagttgtatcacctttaattacctagccttggaagtcacactgtcatttctgctgcgtattattctttagaagtgagtcactaaggctaacccataatcaaggggagaggaatttagattccatctcttaatgggaggagtgtaaaaaagttcacaaacacatattaaaactagcacatgtagccttacattagagaatagtaaaactaaatatataataaacttggatgtaatacgggagatatacaaaatgtttaacagctggtttggcatgggccctgaacaaatagaagaaataacagcatcaacaactggtaggatctactggtgcagctgcttaatatcagctctgggtattatcaagtctccatacgtgccctagagtcaataagagccctgggaggtcaggaatggtaagatcatgtgtctgaaataagatgttttcgttattcttgttgaagcttcagaagccccattaaggtctagtttcagagactggttgtttggtttgctttgtctacctttgtctaccagcagttaggaacattttccctgcatggcccttacctgaatattttaaaagtttgttattttaaagagaggggagttgggaagaacaaaaagagaagggacaagctctaggaatacacgttatcttttgtatgtattatgattcattccagtgttatttagaagccaaggcacccacctggattttcccctcttgacctacaaatgttgggttctttggatagtgcattagtttcctattgctactgtaacaaactcctacaacctaagcagcttaaaacagcacagatttattatctcacagttctctagctcagaagtctagggtagcttggttgttttctctgctttggatttcataaggctgaaatcagagtgtcagccggctgggctcttatggggaggttctgggaataatccccttccaaggggattcaagttgttggcagaatccagttctttctgattgtaggggtaaggtctttacttccttgctggctatcgcctggaagccactctttgttctcagagggatttatgcagtccttgcccattgcccctacatcttagagccagcagcgtgtcaaatccttcttacccttcctcctctccgacttcctcctctgttgcatctctctgattccagccaaacaaggttgtctgcttttaagggcttgtgattagattgagcctacctgaataatccaggataatctctctattttaaggtccttaagcttaattacacctgcaaagtccttcttactatgtaatgtaacatgttcataggatccagggattaggacttggccataattttacctactacaggtagccaagttaggtcaatagaggtgctttccccttcacttgtttcctcaggaaagtaggccaaccagcaagtttatgttaaacactagggcttaattgaaataccctaaatttgaaggaaaagaatatgcattttatggaaatatgtctaggtttcggttttgaagagagaagaggtgctctttcttgatttccagtaatgtctacagtataatataatgcttaggcgaactggtttgaagtcagacagaccaggcctcgtacaagcacataatgctcataaatctcattatcctcgtctgtgaaatgggctaataattcctatgttgccatggggaaaaactgatgaatagaaggtgcttaggacatagtaagtgctcaatgaatgttagctaaatataatgataatgataacagaatgacatattcatagacttctttgtagctggggagaaggtatgagtttaccaactagtatcaataattgggtttcctattagtttcatattaacctgatataaattaatttgttagtctgacataattatcctattagacgtaaatgagtaatacaattattctagaaagggatttatacaagttttttttttctttttaatttttttagagactggaacttctgggctcaggcagtcctcctgcctcagcctcccaagtagctggaactatatttgcatgccactgctgggcctaggagtttatttttagcaattttgcttaagatgaattgcttggttttaatcataacaagcagtcactgaaactcacaaccatctaagtcagggtttggccactatggcctgtgggccaaatctcacctgctgcctgtttttgtgtggcccatgagctaagaataatttttagagataaatgtttgcaggtggtttgatgatggggaagccctaactttgttctgttttttgtttttgttttttaattaaaataacttttgttggtacgtagtagttgtaaatatttatggggtacatgagatattttgatacaggcctgcaatgcataatcatcacatcatggaaaatgggagtatccatcccctcaagcatttatcctttgtgttacaaacaatccgcttatattattatagttatcttaaaatgtacaattactattgactatagtcaccctgttgtgctatcaaatactaggtcttattcattctttctaactatacattttttgtacccattacccatccccacttctcccccattcccctaccgcccttcccaacctctggtaaccatccttctactctctatctccacgagttcaatcgttttggtttttagatcccacaaatacgtgagatctcacaaatacgtgagaacatgcaatgtttgtctttctgtgcctggcttatttcacttaacataatgacctccagttccatccatgtgttgcaaatgacaggatatcattctttttatggctgaatagtactccattgtgtatatgtaccacattttctttatccattcacctgttggtggacacttaggctgcttccaaatcttggctattgtgaacagtgctgcaacaaacatgggagtgcagatatctctttgattattttctttcctttgagtatatacccagcagtggggctgctggatcatatggtagctccatttttagttctttgaggaacctccaaattggagaagcataactttgaaccccaattaagcaaaaggttatctcatcccaaaataattccgttattctcattaataggcatatattagaaataattgtactcagctgggcatggtggctcacgcctgtagtcccagaactttgggaggctgaagtgggtggatcacttgaggtcaggagtttgagaccagcctggccaacatgccgaaaccctgtctctgaaaaaaaaaagagaaataattgtacttgattactattgttattttttggatttcatcaataaaatttgtggacagtttgctcttaagtacctacgtaatatccttgattttgcctctttgcctgtaaagcctaaaatatttatgatctcactctttacagaaaaaaatttgctgactgctgatcccagtaacctattgtgcatttaaggtttgggtgtagactccttttagatagaagggatcctttagatgtcctaatgcaatgccttaattttatagctaaaaccaaaccccaggaaggtaggtgactcttcccacacaattcagctagttagtgatagaggcagtacactttccactggagcaggcagaccctctgggtggcatagttggactttattcatctttctttaaatggacctctgtgttgtcaccaatccagaacttttaaatggacaggccagaggtaatgcagcatagaaacccaattgtccattcaacccattgaatagggcctggcaaatatatagttgctgtgtttccatttgcagggacagccctttagattctagaatttctctttaaaactttttcaaaagcactggtgtgctgactttttttctgttaagttagtaacaataaataactgggcatgttaatatattttcattgagccatgttcagtttaggatgagattgttcattgagcagtacagtagccccaaactgagggaataatttcccctcatgtccaacatccccattgttccatgttatctgctaataaacccagccatgctgtgtttgtctttgcttccctcctgcctgtataatgatgattgctctctggcatttgtttctttttctacaggtggtttacaaatccgacgactgtcaatgccttctacagtgcatccaccaaccagatccgtgagtacgggttccttgtctccttggtaacctggtataaaatgcaaagaacttttccatgactatgatggagggtaagacatttcttatttcccccaaaagtggcagggtatgctggtgaaggaaggttgttctcctacctatatgccaaattttcctcactctcttcaccttaccagttttttttaaagctttatgtcaccactgattgaaaaaaagtcaactacagtaaaccaaattaaaccataatgaagtttgccatgaaaaggagcaagtttccactttcctttcataatggccttactgattttgtccatgccattttattcattcctaggattggtggggaaaacagcaggtaactgagcagattgtagaacctgagcggaccatctgtatgtaagaaagaagcttggaaatattcttattaacgctaggaagttatgtcttgaggttttctacttacatgtatcaggtatatgtaattaaaaataccatgataaatttaaaaaattattatttttattattttttaaagacagagtctccctctgtcacctaggctggagttcagtggtacgatcctggctcactgcaacctctgcctcccaggttcaaattattcttgtgcctcagcctcctgagtagctaggagtacaggtgtgcaccaccacgcccagctaaattttttttatttgtatttttagcagagatggggttttgacatgttgactaggctggtctcaaactcctggcctcaagtgatctgcccaccttggccttccaaagtgctgggattacaggcgtgagccactgcacctggccttaaaaaattattaagatctgaatggcacaaataaaaagtctgacagcttccagccttggcaataaggacacatactcactgctggtggaaagatagatgggctcatccactttgcagggcaatttgacaatatctcaaaaagctgaagttgtgcatgcatacctatgaccatgatgtgtgctcctggaatgtgctctaatgttgtgagtcttgaaatgtggtccttggacctgcagtaatagcatcatgggggatcttgttagaaatgcaaattcccaggccccaccttaggtctattgatcaaactttggatgtggagctcagaaatctggtgcaataaaacctgcaggtgattgtaatgtatgctaaagtttgggaacagctgccctagagaactcttgcacaaggcataaagaagcccatgcaaaaatgctcataacagtattatttataatagtagaaaaagcaaaataacctacatattcctctgcaggaagatgagtcacatgtggcatattcacacaaaggaataccatacagcagtgaaaaatgagcaacatatattaacatggatgaatttcacaagtaaaacaacttgggaaaatatatcaagtatgatactatataaataaagttgaaaatcatgcagaacaattctacacatggtttggaggtccatccatttgtagtgtaagtgtaaagacattcatgagaatgacaaacaccaaattccggttggtggtggcttgtcttggggagggtgggccactgttgctcaaatccttgctggtttctcctcatctcccatatctcttaatgatggcatgccccaaggctcagtctgcaccttttctgttctcttctctccatctttgctcacttgcttggtgataacatctaatctcatggttttaatcacatttctacagtgttgaatgcaggggatggaatttatcacccttgttcataccactactatctcccacctggattatggtaatagcctcctcattggcctccctgcttttgttcttaccccccttcagtctattctaaatataatattgtagcgattttaagacgttttacaatcacatcgtgtcacttctttgctcaaaagcttttatcagcatcccatctcactcagagaaagagccaaattatttataatggccttaaggtctgttatctttctgcctgtacctcctgctactctcccccttcctccctccttctgttccggccacactggcctccttcgtgtttatagagcacacctgacacgctctgctctgggagcatttatacctggggttggctttctcttggaaaacttccccaagtgacctgcctggtttatgctcccatttccttcaaatctttattcaaaggccaggccacctccttagggaggcatcctgccttccctctggccagttggccagtctgccgtgggtcctccatactggccgttgttcctacaggactctggtcagaggacagccggaaggctgtggctgctcactaccagctggcacatcttcttagagccgccctcgtgtggccactgttaggaatggcagtttctgcccgacttcggtctgagagagaaatgaacagaaagacgaaagacaagcagatggcgggatttttttatttatacattaatttacataaccaagtaagttgttaaatattttgaatgtcacttcttactgtataaatattcattatcacgaaactaccattgctttcttaaggccctaaatgccaacttgagaactaagttgcatatgttatatgggaacttatgatatttgagttattaattataactaatacttataataatttattattaattataatcacatttaggacattctattgggaaatagaaattgtttagattattcacttaaaaacgttttattgtctaatatttggtacatgcaaaagaacatgtaacattttggcacatataagttataaagaatatatgaaaacatgacgaaattaatatgtgcctacgacgccctcaccccatcaggaaccatccctccctctcaccacagaagtaacactcttctgatttgagggtttatcatttttgttttgtttttttaaaataaaactttatttatataggtatccctaaagaatatgttgtttatttttacttgtttcttagtataataaaaatggtatcttactgtatgcaatcttaaacaactgcgatttttcagtcaacatgtttttaggatttgttcgtgtagcatgtggtggtaggttgttttcatgttcactgctgtataatatttcatgactgtacccccagattgtttattcttctgttgtccagcctatgagtccccacacccaggtttttgcttatgaacagtgctgctctgcatattcttgtgaatgtctcttggaacaagtgtctgagggtatacatccaggagtggaattattggctgataggaagaagttatctaccagataatatcaaatgttttccaaagctggtgttccaaagtacagaagtgtttctgttgttcctcattttcatcaactcttggcattggtagatttaattttcaccagtctagcgagtgtaagagatcagctctgatgcaagaaaagccgacgtttccgcattcactttaaaatgtcactgaaggcttactgctccttggggtacttaagtgtgtctaataatagttccatctccagggttcacccctgctcagcctttttcttgcctgggaagggctaatcctatcagaggtttactgaggaagaaaccatttcagggtaacccaatggtttcatgaaagctcatgggcagagggttttttttaaaatgaacaatttgaaacagtattttaattaagagattcaagctgtttctgttttcctaatgaccagtgcttgctctcattgtaaattacattcccaggcaagatgacaaggaatcctttgggtgacttttttttcccctctctcctttctgattttctggactacaaattaagacaggtggagtttcttcttacacacttccccaccgggtttcctgggacttcccccaccctacaactgccttctttttgcttcgctgaagaagtgaaaaattgaggtgattctctaaaatgaacatctttattgattaggggctgattctgacagcatgtggccatctgtttaattgggttttacatctaagatgtaactatacttagtaacgtgatttatgacaatttcattcagttcccattatcattttctgatttatgctacttaaatcttcttctgcacgcaatagagacttgaatagaaaacagaaaaacctgtagttgttttttctttttcaaatccatgcctttgtgtggaaccctatgatttgtggccatctttcaatgttagatttttacagggtggttacaacttcttatttttcttcccttgtcaagctgggtagcaacgtctctagacatggcatgtagtgtgaaattataatgatttaaatctgctgtatgaggagttaaactcagtagctgtcataaaatttaattatatttgaataaggtggttaaagaggaaaacacaaatctgaaatgattggtgcttaaccctaactttgtgataactgcgacactgatcttgctgcttttcagagtggcaaggtgagaacatgaatcagagatctagtttgtatggccttagtcgaggtttttatccttccagacccctattgtcctgtctgccacatgttgaggctatctagcccatagggttttaggggaagatttaatgagacgaatttgtaaagtgccagcacattgccaagctcagggcttgtatatctaaacctggcatgccaggaatccctgcgataaccattgtgtcacaagacaaacagcaaaatataaagatcggcaggggggattatttcaaacttttgccctcaagagatcttaggccgggcatggtggctcacgcctgtaatcccagcactttgggaggctgaggcaggcggatcacctgaggttgggagttcgagaccagcctggccgacgtggtgaaacctcatctctaccaaaaatataaaaaattagccaggcttggtggcaggcgcctgtaatcctagctgctcgggaggctgaggcaggagaatcacttgaacccaaaaggcggaggttgcagtgagccgagattgtgccagtgcactacagcctgggcgacagagtgagactctgtctcaaaaaaaaaaaaagagattttattataatgttccacattataatatgtatgcatgcaactgactaaatgctgagtaaaagaagccaggtgtaagactaaatactgttctgtttcatgtgtataaagttcaggaacaggcaaatacatctatatgatagaagttaaaataatgactacctttgttgggggtattgactgagaggaggcatgtgacacattctttatcttgatctcagatgtggttacacaggtgatacaagagtaaaaactcaccgtgttctatcattaaaatttgtgtctggctgggtgtggtggctcacgcttgtaatcccagcactttgggaggccagggtgggaggattgctttaacccaggagttcgagactagcctgggccatatagcaagaccctgtgtctacaaaaaacaacaaaaaattagccaggtgtggtggcatgcacttgtagtcccagctactctggaggctaaggtgggaggattgcttgagcccaggggtttgagacagcagtgagctatgattatgccactgtactccagcctgggtgacagagcaagatcctgtctttaacaacaacaaaaatgtatgcttttactgtatgttaagtgacacctcaaaataaataggaacactgctccttttctccataaaaatgtttggaacagcgtatagtatgcatggacatctggagctaataataggttgcctcaggctaagtctctagatgtgtagaccagggattggcaaactatttctgtaaattgccagatagtaatatttttggctttgcaagtcatagtgtctttgttgcaatttctcaactctgccatggcagccatagacagttcataaaccaatgaacctggctgtgttccagtaaaactttatttacaaaacaggtggcaatattcaggtagtggtagtggtgggaagagtgaacagctcatatttggttttcatttctactaacatggattggtctttagaagaaaattcattttaagtattcactatcaatgaatatttgaaaagcgcctcatttaagtatttggtttttattttcatacatctcaaatcaaattaaagaagtatcttaaacagataagatcttggcttgaaaacaagcatggcctaagggctaaaaccaatgattttattatctttgctgttatacacaagggatttttttcccctcagtttaatcacagatattctgctaaagaagataagcctttgtccagaggctgggcttatgggggcatcgaattatggaattaacctggaaatcaaacatagatttgttttgctgttaaggaaataactgtgtttcaaactgggagaatttctcatacttcactggctctgcctgaaaccataaagtaaaagctaagttagcaaatactcacctgtggcttctcttggaatttaatgaaattaaatctttgaatccacttgatgttccatctggggacatgagaatataagactaatatatagaatttgggaatagtcttccattgtttttagagctagaaagaaacttaagtggtcacctcatccaaatttctcactacctaaaagagatcctgacactcagagcaattcttagtaattttttttccacttattcacttgattttcaagtgaattttcaaggccccaatgattttcacttcccggtattcattcccctgtctagtcccctgccacactgagtaaggcttaccactgtaactaataggatgctatggaaattctagattatgacttctgaggctgggtcataaaaaacattgtggcttttgttttttggataatgttcactctgggggaagccaaccaccacactgtgagggcattcagggagctcacacagagatccacatgtgaaggaactggggccccctgctcattaggagtaccatgtgagtgcgccatcttggaagtagatccccagtgcagccaagctttcagatgaccgtggcccaggctgacatcttggctgcaacctcacgagacactgatacagaaccacccaaataagctgtttccaaactcctgacccagagaaatggggagatagcaactatgtctggggatgatttgttacacagcaagaggtaactaatatagctattagagcatgcccaggtactaactgagtttggtaggagggtatataactttgtgtggtttagtggttaagggtgtgagctctgaagtatgacagtttgattttgaatcctggcttggccactaataacttgcaaccttgggcaagttacttaacatctttaagcctcagtttaattatctgtaaaatggagctaatagtagtaaccatcctatagggtttttgtgaagattaaatgatactatatatttaatatctaatgttatctagtacattttataatctaatattagatacataatattaatatgtaatattaaatattaattatatctaatattaatatacatttatagttatatattataaattatacatataatatattatataatatttatataatatatatcaatatgtaatatataagtatatattaaattatatatacttatatatatgttaatattgtatatataatatcatttaatcttaaccctataggatggttactactattatatatatatataaaatgcttggtatagagtgtggttcatagtaggcacccaataaacattagctattagtccttgcttttgaggagctgggagagagagacttgttaccaggtcatttagaagacatcatggtgagtgtgcaacagaagggtgtgcagtgcattctgggagccacagtggaggggcaattaagcctgggggagtcaagattggattccctatgaaactgatgtttgagtggactttggaaagaaaaagaaatttctctgggcacagaagtgagattagggcatttaggaagaagcactgttgtttggtgcaaaggcgcagatatggcagaacatagcacaggaacagactgtgagatggccacaaatgctggggcacagcttgcactggtggaagagacagcaaagggagtgatgggagatgataagtggaaggaaggctttgtgggtcatgtcaaagaacaggccagagggagctagtatagtttttttgcggggaggcaaataacttaagttttacttctgtattggtctgttttcacactgctagtaaagacgtacccaagactgggtaatttataaaggaaagaggtttaatggactcacagttccacatggctgggaggcctcacaattatggcggacggcgaaggagcagcaaaggcatgtcttacatggtggcaggcaagagagtgtatgcaggggaactcccatttataaaaccatcagatctcatgagacttattcactatcatgagaacagcatgggaacaacctgcccctatgatttaattacctcccactgggtccctcctacaacatgtgggaattatgggagctacaattcaagatgagctttgggtgggaacacagcctaaccatatcaacttccttaatcctagtattaaagatcatggtctggagagggacagattgcagccactaagaccagttaggagttttgcaaatggctcaagagaaggacggggagggcctaaacttaggcaatgacaggggtgaggaggagtaggaagtttataaatcatatcccaggagataattgtcaaataactgcataatgataatacagatagcacagtgatcctcccttatccatggttttgcttttcattgtttcagttacctatgggcaaccaagttctgaaaatattcagtggaaaatgccagaagtaaacagttcctaagttttaagtcgtgtgccattctgagtagcatgatgaaatctcttgctgtccagctctgtgccacctgggacgtgaatcatctctttgtccagtgtatccatgttgtatatgctacttgcctgttagtcacttagtagctgtctcagttaccagatcaactgtcacagtgcttgtgcccaagtaacccttatgttacttaataatggccccaaagcataagagtagtgatgctggcaattcaggtatgccaaagagaagcttcctttcagtgctaaggtgaaagttctccacttaaggaaatttaaaaagaaatcatatactgaggttgctaagatctacagtaagaacgaatcttctatacatgaagttgtggaggaaaaagaaatttgtgcattgtgtgcgtgtgtgtattagtttggtactatctgaggtttcaggtgtccaccaggggtcttggaacatatctcccaaggacaagagcggggactactgtacttttctaacttttccactagggctttacaggacttccatcaaatggagattataactgttctgtgcagctaggctttgctgaggaaccattaatatgccaaccattatgccaggtactttaatgtatgttatctctaatcttcacaacagttctataaacttggtattatgggctcattttacagaagaagaaactgaagctcagagaggtgatgcaacttgcaaaagactgcaaaactagcaaattgcagagctgggagtataacccagcttatctgattgcatcctgtttatcgtcacactacactgttcaaaactggataggaaatgtgagaattacagtcacgtgataggctgggtgcagtggctcacgcctgtaatcccagcactttgggaggctgaggtgggtggatcacttgaggccaggagtttaagaccagcctggccaacgtggtgaaaccctgtctctactgaaactacaaaaattagctgagcatggtggctggtgcctgtaatcccagctactcgggaggctgaggcacgagaatcacttgaacccgggaggcggaggttgcagtgagctgagatcgtgccactgtactccagtctgggtgacagagtgagactctgtctcaaaaataaaaataaaaaataaaataaaaaatagccatgagatgatatacaggaacacactctgaaaaggttaagggtatgatataaatgtgttagagtaatcattattatatcaccccctcacccatgctgctcgttcactggttgggggattgtttctcttctggtatggaaacaagatattatagaatgtaaggcagccaggaggtgagagtgagaagtttagatggtccccaagtcctactgatttcatgtccaaaagggttgtggcatcaagcagttcattattgcctcttctaacgatgctgttctctgcaagctttttggccaagcctgtgatctccttgggtctttagcttatgggaagagtggaggaggggttattctgtaagctagcttaaaaggagtatttagatatactcccccaaaaggctttactttccaaagtttacactgagattttaaaagttttgttaagtgagctgaagttaagtcatgaacaaactttgaatagtttgtgaaattgacagatgatgcacttagcaagtctgtggaacacctgctacaacttttttgtttttgttgttgtgacagagtctcactctgtcacccaggctggagtgcagtggcccgatcttggcttactgcaaccttcacctcctgggttcaagcgattcccctgcctcagcctcctgagcagctgggactacaggcgctcaccaccacgcctggctatttttttaaaatatatatttttattagagacaggagtttgccatgttggccaggctggtctcgaactcttgacctcaagtgatccacctgcctcggcctcccaaagttctgcgattacaggtgtgagccaccatgcccagacctgctacaccgattttaaggcattcttgtcctggtctagttgaggaatttggaggtcctgatacagacccccagtttctgaagcctaaccaaggaggcacctgagaatggtgttctgggtagtatcctgggaggacaaaactagcttcatctggaatgctctgcagtctcatgggattcctgttaccatggtaagtcccagaaccaatgcctgtaaggatgcaatttgccgcttgcagggtatttctaaatgctgttttcagacatagtgcactggtcaggttggctgcagggctggtagtaggaaagcatgaaatgattatcagagtcaacctgattaaagacaggatgtaagcaagccagggtgaggtgagcatagggacctaaaaaccagccatgggaacaggagacaggatgtcagggagaaatctcattaattgaccttgatggtcacagtctcatttgtcttctctttaaaaaatcaattgttttttacccttatttacaaaaggagttcatatttattgtagaaaatctagaaaaattttaagtgaactaaaaatttaaaaagttaatatcatttaaagatagtcatggttaatacctttgttgaataccactgagatgtatgtttatctacaaatattttacagtttaaattaactagactcatccaacagtactactttttccccactgaacattgtaacatgaatattttttccatttattacatattcttccaagtcatcgagtgtagtgttcaattgagaaaacaccttaatttatttaattacttcccaatggacatttaggctgtttccctattgttaaagaaccctctgtattaataagttttgtggctttctgtctaaatctgagaccatttctttagagtaaattcctagaagtggaggagttgctgtatcaaatggtatgccccatttgagggttttgaaatgcatcttacccaacttctctcaagaaagcagtacaaatttgtatttccagtaacaacaaatgagatggtttaacctttaatgagttgcatcttaaagatactgttggaggaaatgaatagagagactcagttttttgtctaactgatatagggaaaatatcagtcacatttcattcttgagaccattattgcataaccagatatggttcagtgaacccacataagcatttgttgagtacctaccatgctcccaggcctgggctgaatatccctgctgctagtgtcagtttcaaatacttagtacagcaatcaataaatgagaggacctgttggaatatgagtagaatatgagacaccgagctttatagtggaaggaaattagtgttttctttgccagatgttaaactatagcagtggttctcaaagtgcggtccctggatcatcagcatcgcttgtgatagatggggattatctggccctacctcctgaatcagagactctgggatttgggcccagcaatttatgttttaacaaggtcttaaccaccaaacttctgcaagatgccaaagattgaggaccgctgagctataaaaaggcagcaaatgcagaagaggtcagacttgttgggtaaaggtggggtgactaacttctcctggtttgcctgggaccatcccagttttagcacagaaagtctcgcatcccaggagccccttctgtcccagctagacagggatggttggtcaccctggtaaagggtggcaggggtgaagggaggttctctttgttgcagcctaaaggtaattatggcagaaaaagaatagaagggccagcagagaaggtttcaagatggagggcagatttcagaagctgctttctgcttgtcagctctaggctgatagatgtggtggcaggaggttacctgcaggaagccagcagatggctaaggcatcttgctgaatcccttgacaggagtcacagctgttagaacttgatactttctggaaaggggaaggttggcattcaccaaactactgcaagatgccaacttgaaaaaaaagccatgattaatcttagcagtgatgacaatgaaatcattttacagcaaaaaccataaccaaaagtgctttgtaattgcagcaatttccatgtcctgactgatggccccctagattctagaatggtgtcgggcttatctgattacaagaactaatcctgaataagatgtaacattcattcttagagtaagcattcatcccggattttctaaagcaggtgcaatttaaactctttttgttctttactacagtcaataatgtataaggcatgtaaagtttcagttttgaaagtatagtgtgcaaaattttaataaaagtaatcatacgttacattgttacatgcatggtgttgatgacagaaagacaggagggctgatttatagatcagttaaacataagaaattccttatttttcctaaaccaacaattctgaacctgttttcatagtcgaatcacctggggagcttttaaaaaatgcttatgttcagggttccatcccagagatggtgacttaataggtttgaggcaggggcttggacatagatattaaacaagcaaaattccccaggtgatgtgcatttggggttgagaatactgtacttaccctgatataaaccaatgggtcccaactttagcatgtaccagaatagcctgaagtgctattcagtaggtctagggaggtgggggtgcaaacatttgcacctctaaggagtgccctggtgatgctgatgctgctggtttgcagaccaagatttgatcaccagtttcctaaaccattcctactccaaaccccagataatcgtacaaaccacatctgtcacccattagctagacatgtgaataaataactccctctcaaaacacttctgcacatctactcccacgtatccagtatttcttttctctactgagtttaaaacatatttcaattaaaaagcatactttagaaagcttggtataggtttaccttcctctttaggtcttgcaaaataggattatttgtcgagtggtatcctttctccctcactagattgtaggttctctgaggacatttgtttgttcgaaggttgcccatgtggcttaggacatcataggtgctcagtaaatgttagtagtcagtggttatgcatagaaattgcatcatcataaccaaacccacctattcccagtagtttttataatgggatctaaatagactgacactccaaaattaggatcataaaacgtattcacttagagaagtcgaagctattgcacaggacaagtaaaataatcaaagaagttagcagaaggtaactacaagggaatttcaccaagaaggacaataatgtagataagatgatatatcagcaatagccctgaaatgtggactgatacatagagtagtttagtaatataagcacacacttaaggcttttgaaaaaaaaataactgtcacaacttgtactggagccacattaatacatcaaaaaatccatgcaaatgaccaaatatcccattgtttgacaaaactaataatgcaacagaatgtattgacatagtccaccccttaacaaaactatcacaaacatccacactgaaagaaaacagacacaggtacacacttaatgaaaaaacccaagtatatttctggagaaagcagctacagcaaatatggaaacagatttagttcaataaacagctgaatgtgtatgctggtccacacatcctcaagcccattgaattttcctttggaattttcccttggtcacctttttttggattgaatttactttgtcatttgcccctggctctgtcacttctgtccagaggctgctgcagggatcctaaatgaacaaattcaatgatgcttattccttcagaggagtcaaaagagatgttgaatttaagaatgaaatgctcctgaaggtagatgagttcaagttgtcttgcattgtgttactacacttacaaaagtttgctatagagaaaggagaaaagcacatggtctgggtttctgaagactggcagtgaaagttggaggcttcctattttgtaaaatctgaccaaacatggaaataacaggaaaagatgtctgagtctggttcatagttgtctaaaatcatcagcatttataagttattaacacatcaatattaaaaattaatattaaattattaatttattaatactttattaatattaaattattattattaatatttaaaaaacttccaaataacatacaattttggaaggtaatgttttaaaaatattttctgtatgataacttttctgaaccatacacttatgaatatggaacttaaaattaatgctgcagtaaagtgaacgcaacaatgaatgtagggaaaatggattaaattagttcaatattctgcaggccgaaggcctttgatcaatattttgtctaattttctctttccagcatatatcacaaacataaaaaggaagaatattccacttttattgggggtcagcagggagggctaagaggatacaggagtgatggtatttgcataaaactggctggactatttagcttgttaatatctgtattgtgattgaaagtttattggaaaaatgtgctgatctcaaaactacactagttcggcaatgatagcaagagaatggaaccaacaaattctttcatctagaaggaaaatgaaaaccagaacttgaataatgggatgtatcttagatctggtactgaatgtggaaaattcaagaagtaatacattggtactactaatagtatcatgtaaggttttaaactttgtctaacaagatgtactcataatgataggtaatgcttcaaccccagtcatccctctgagtttcacaagatacagaatcagttaattcaacaagtatttattgagtgcttaccatgaaccaggtattgttctagctctgaagacatcaccattaaagaatagtaaaaaataaaaatcccttttgtcatggaacttgcattctagttggggaaagacagaaaacgcatacaaaataagtcaaatgtaaactgtcttagatggtggtaagtgttacgatgagttacaaagcaagaaagtgggtagaataacatcctgccccttaaaaaagcactagggaaggggttaatgaaaagatgatcttagcctacatacctgaagcgagccatacagatagtggcggaaagtaggttctaggttaggagaagagaggcgtagggcaaaaggaaaattattccctttttgcatgtccttctatacagtgtgaatttgctaggcctgaatatatttatttatttgttttcttgaggtctgagctgtggaataatgtgctaaatttgttttcttctctatacttgtttgtactaaaaaaaactctaattaatgcagcttacaataatgtgtactgaaacccagacacattgaggcatttaacttttctgggaaagctgtagctaccgtcagggtatgatttatgactataaaagtcaaatagttgagcctggggtaatcacccactgaatgtgattggttctttggcaattgtgtcctaaacaaaagcactctgtcttttatggtcagcattttgctaagctccaactaggttactccatatttactgataggagaattgtaatgagaaacaccagtaaaaaggagaggttgaccccagtagaaaaccaaaagcaggttcttgtggctttcccaggtgcagatttgaaaaagacagtattactgataaataattaggttattacaaagaccaatattttcttttgtcagaattttaatcattgaagtggtataaccacaatttgtatttttgcctgaaataggagtggaatttgctggtgttaacaaatgcaagaacaaaataatactatataagcttagttaactgtttttcaatagcctttagaagaattttctgtaatacacacacacttctttttttttgagatgctaaaagaaattttaataattgttacataacatactgtgtagctatttgatgaaatctacctctgtgtaataattattaaagtaagtcttgaaatgtatgataagaatatattagttttttgggtacaatttccatgaaaaaaataagaaaacaaataaataactaaaataagaaataggaggttttttatacatactgttgtcatcatacaaaattactctattaactaaatttacctgacattgtcaccgttaaaagcaaaatcaagacaaaactaattctcaaatttatttaattttagtaatatattttatttaaccctatatacccaaaatattttcattctaatatgtaatcaatatacaaaaattattaaagagatgttttatgttcttttttcatactaaggcttgaaaatccagggggtattttatttatttttatttagtgtactttaagttctagggtacatgtgcacaatgtgcaggtttgttacataggtatacatgtgccgtgttggtttgctgcacccatcaactcgtcatttacatttggtatttctcctaatgctatccctcccctagccccccaccccccgacaggcccctgtgtacacacacacttatttctaaaagaattaattttaattacacaagtttattatctttggataatcaaaaggtaaaacattacgtttatgtgtagagccctttttacgagccaccaccccaaatcctgattttcttcaaaaggtaaccactgtgatcactttgataggtattttacagacttttaaggaatttacatatgtatacacatatacacacaatacatgtatatgctcacactggtaggatagttatgtaagaagataaatggtatttatatgtctatatctgtaccttgctttatgccaacaacatgtcttggggattatttcccatgctggaattttaagacctacctctttcttttcacttactgcatagcagtccacaatatggttataccataattaattggcctcttatttggacatttagcttgttgcacacttctcaactacaagccatgcagcaatgaattctgtagtgcacttgtgcaagtgatcaggcagtggttctcacggtggcacccagaccagccgcatctgcatcgcctgagaacttgctagatgcaaattcttagccctaccctagacttattgactcataaactgaggatggggcccagcaatctgtagtttaacaagccctctggtgaatctgatgcattatacaatttgaaaaccactggcaggtatgtctgtttctacagacacacatgtacggatacagtcagttctataatgtaacatatgtgttcttaaacaccactgtgctatgcaaaagtatgtaataaaaggcctcggggcttttgagaaaaatgaggttggggcacaacagttaaaaacttcatcagtgacacgttaaaaacaaaagctgggagaccaataaaaatgatagtgcggttttatacatgttaaatgggtaaatacacaaacgctacagtaaatatggcaccttcccttgaaaagaccagaagtttgcttgtgtaagttggtattggaggggttgacccttgtgagtttttgggtagtggcggaaggagggttacatgaaattggaaggtaagttttaacagcagatgtggtgagtgtggctcctgccgcacgtggtgaactgaggcagttggtcatgttgaggtgtgtgtgtgtgtgcattttgggtattcctatatggctcagtccatttgggtgcatttttctgcttttccctagcatttcttgtggataagcaaatgcgaaattggagttatgtccaaattttcccccagtgtatcaatttccttggaataaatttgccttttcgatacaggtgtcacagctgtatgtatggatgcttattcttttgcgtacattacacaaaataactccatacactgtactgaatgctgtttttcacttaatatttcttagagctttttccatatcgccacatagttactcgtttttttttttaatggcatttaaagcattaagagatgactaaattgatctccaaaatgcttgcaacaacctacactcccatcaacatgcttcctacaccttggccaatattacctattatcacatttattaacttttgccaaccactagttaaacgtctctctccttcctctccctccctctcctccctctcctccctctccctctcttccctctgctccctctgctccctctgctccctctgctccctctcctccctctcctccctctcctccctctcctccctctctctctccctctccctctccctctcctccctctgtctcctcccccacctccacagagacatttacactgtgaggaatgcctcccgtaagtacactgatagaaaaaggaactttaaaagtgtgaaacaggtggcgaggtggtgttgaaatggtaaaaaaaaaaaaaaataaataaataaaaataaaaaggaaataaaatggatatgaaagaatacataaaaacctattaaaaaggcagaaaaaaggaattccctttctgcttatttttcacttctacctttgctaaatacaacttatccactttatgagataagatattgagttgaccctgtaggattccatctatcactctagctggttgacatctccaaaaatgcagcttacactattaatccattcacttcagcaaaacatgcctaagggcatcagattcttctgtttatcagtattgggttccttggccccaacaagctcagcagatacagctgaacagagtgatgtgtggtggcttcaactcttgagtctggggcttctaacggcaaaagtgacagacatagaggctcatgcaggtgtcagatgttttcctgtaaagaggttggcaatggacgtaaatgcttccagctgggcacattaccaggcaggataagccataatgatttaataatgaaatcacattggtttatgatcattgttcttattaggaaatatcattgctttttgatgatttattatgtgaaactgagttttcatataaacactgtgatttgcatttatttgtaatatatatttgcatatgtatatatatctgagtgagaatgacttactaaaagtaatcaccaaaaaaagaggatggaatattgatgtaaatatgccacaaatatttaaggaaatgtagaaattatgaagattattatgatgttgccacttcaaaataatattagatgcattttcctttatgtgaaactgacagagaactagtagctggatccatctctgttttgcaattaggcttttgcacctaatcacaaactacgatattattaataaaatataaagaatatatataagggttatatagaaccaccatttcccttctaaattaaggacttgctttcctgtcctcatttctcctcatgtgttctgacatggaggagagagagaaaaaaaaaagttaagaagagggaggaagaacattttgacttatgaaagagctttcagtctcatggggcctggaacagttgctctggagcagtgaaggacactacagaaggcttctctctctctttttggttatgattctttgctctatcagctgtgatgacttgtaagtacagttcctaggatcaacccagggtgcaaaatttagtggtgagttgcaagggcaaagcaaagcatgtctcccactcatctgcactcaatgtcaggtacataatttgggaagcccagtgcaaaataaaaatgtggggtctcttgttccaaaagcaggaaaaaatgccattgagggggctaaaatataaagccttgccctatctttcatgggctttctctttcaacttgtcatggtattgttttatttgctattcagtgctactataagaaaaattaaagacgtaagtcattagcctgagtgttacttttcatctcaatattgtgcaatgtcagttttaaatgcaaacataagagcatttaacttggatgtggaatcaccaaaattacatagtttgtattttgtagcttgtatgtgcgtatgtattttgttcttaccagcatggaggaaatgctgaacaaaactcaactgtttttattttacttcttaatacatgtacattctaccaatactctctacctttggtttactgatgaataaagaaggactaaaaggaaaagaatctataggttattgtataagtctgttctcacactgctaataaagacatacctgagactgggtaatttataaaggtaagaggtttaatggacttacagttccacatggctgaggaggcctcacaattatcgtggaagataaaagaggagcaaagtcatgttttacatggcggcaggcaagagagcttgtacaggggaactcccctttataaaaccattggatctcatgagacttattcactaccatgagaacagtatgggggaaaccgcgcccatgattcaattatctccacctggccccacccttgacacatggggactattacaattcaaggtgagatttgagtggggacacagccaaaccatataattcaccctttctctgtccttttctgtcatcgttttcagtgtaggtgtttggccaatacagggaagtaacaggtataagaaaggttatgacaggattccttggtcattcatgtttcttagaatgccactaccttcttttggtggttgaagcaaattctggtttgaatggaaagtatggcctcttagggctatcagagcttactcagttctagatgtatcgtatttaccttgtatttgtttggcatctcgctgaactcccatgcactatgggcctgatggagtcctgtgctcctggggcattgtgaatgctgtgtgtaaatggggctcctaggaacaacagacacatattgtgcacattttctctgctcacacacacatgttccattgtcccctcatgctccactcaaaaaatacaagttcaaagataaaaatcattaagaatttcaagatagtggcaggagaagattaaactaagtgcaggacccttctctctgtggggcctgtgtgactacacaggttgcacacccacgaagccggccctttctatatcaggcaaagctgctggacagcctgaagcctcatgagcatgccatgtatgaaggagcccagcttacagcaggctggatattgccaatagtgtaccagtgcaaaatggtttccctgaaacctttaatacacttacttatttcaaactcagttgaattgatatcattgagacagctagatctcttagagggctcccagtgccaggaggagtgcctttcagatgggtctttgaaacctcagtgttatagctagaaccaggtactcatcattgaatcaatctctctatatctcttaacattttttccttctcataggatttccagcaggagagctccagaagcctttcttttggggaacagaatatcctcggtgagtaaatgagtacagaaaccagttactgaccaattaggaagaacatgttgctttggtagaggacagaagaaacaaagtcaaaggttattcagcagaaagaagccatggaatctggcgtgggtcgcctgtactcttatcattttaggtatttgttttctgatccttgttaccagggtgtatggctggacaggaaagccatcttacacataggtggctttcatttttatgcatttattctcttacccattaactcatactaccagtatttggacattgaaggattgttgggatttgaattgatgggatgagtctaaaaccattccaggtagaagaaacagtgtgagataaggagggaaaagtgcttctataatggcagagtgtagtttggctagcccaaatggtatatgaaaggaagtagtggaaaagaagattgaggtttgatattggagggctctgcatggcaaataaggagcttggatactaataggcaatagaaaatattgaactttttgagcaagttagtaagataatcgaatttatctttagaaatataacctgtgtagctacagaataagtcaaaattggtagtgtatggacttagggataccagtttaaaggtcattttaataccaacagattgtagactcatgtaattcagaatttccatacatagtagagattctgataatatttgatgtcaataatatcaccatttctattatatactttttacttttgtgttttaatgcttggaaaattttagtcttgattctatacattgagtctcttgtgttttggtttggatatatgacaatttaaaaatatgtaggtttaaaagatacagattcccataaatatatcaataagagaaatatgttggcaatgttttcatttggcctttgggctttcccggtagcagaccttgtggtaagtattcaagtgcaattagttctttcgggaggtggtacaaggaaacaccagtaggggagtggagaattgagacagtgagggaaataagccaaatgaattatgtcctgtgagtcttttatggctgccaaaatgaattactacaaacttagtggcttaaaatgacataaacttataagcttatagttctgtaggtcagaagtccaaactggttctcactgggctaaaatcaagttgtcagcagggctactttcctttctggaagctctagagatgaatctgttttcttgccttttctagtttctagagggggcccacattccttggcttatgacctcttcctccatctttaaagttccatagtcacatctccttctgactctcatcttctgtctctcccttctacttataaggacccttgtgattacactggtaccattcagataattcaggataatcttcctgttttaagttcaactgattagcaaccttaattccgtctgcagcccctttactgtgtaacataacatattcacaggttccaaagattagcaatatggacatcttttgtaggccattattccacctaccacatgtgtgttacaaagccagttatcaccatgggcaactggagctcagtcttgctggggaactgtaaaacatgcttcagagtgatcccatctcagggacatgggagctggggtatttatctgtcctccaactcaccttccatcattgattgagggctcctaccaggggtacctggcagtgcccatcctaggccaagagggctctagtggctggagaaagtcttcaggcaactagtttcaggtgctgacatttgaaggctgtcagattggtgtgctcaaaaatagtgagggctacgaggacgtgggcagccatcgataaagcttactacagggaagcaccatcgttagagtaaataaaaattgcaggttcttatttaaccaaatccattaataatatcccaggcctcagctccatagttttctttggtgttcagatgtttggactcaatttgccctgcttttaagtttagaaatatatatatatctaaaaaattaaaggtttaggataaatattctttaagctcccttcaaactaaaaaagtcctataattctttgattctgcttactgttaacaatttaactgagcttctattattgtggttatatagctggagactaggaaatagtctggttggatttctgaagttattgatgaagtaatttgtttattgggtctgtgagcatgttagtgtctatttgtttgtaccttaggctaggtcatagttaatacttgagtgtgaaagagagtttttttttcctaaagacttgtttgtcctcatccacttaatgaatagctactacatatcatttgggtactcagcattgggaatatgaagatgctaaagacatgggagtcatggtccagtgagatggcttcccatatgttcatctagtctgtattaataaatggatagcctccagaatcaagggagtgggtatcctttctgctcacagtggtcagcttagtcctcacctgagtgttgagtctaattatggggcatgaacaagctgaattgtttccagaagagagaatcaggactgtaaatggttgaagacaacgtttcccaaagtgtgtgttccatgaaatagtaatagaggtaagacatcctcccctcccttcagttttggggaatcataataattatcaccataaaaatttcctagaagctctccaagaaagaaacctatttagatgtgtttaacacaactaccttttttgtacccattaaccatccccacttctgaccccagccccccaccacccttcccaggctctggtaaccatccttcgaaatgcagaggttcccaaactccccggtgttttgggaaatgctgatctagaattcatgactgaagaataagagttgaaagaacttaataacacttgaagtggaacctcataactgtctgcatatttttgaaggaaagttaaggtggtagaacgacttattatattcaggagattcagcaagtgttcagttagaggctacactagaccaatagatgggagccatagaaaagacatttcagatcagcattatggagagctattacgtttagacccgcccaaagaggaaatgggttaccttagaaggggatgagctcttggtcattggaaatacccaagcagggtattataaccatttgaatgggtttttctagagggggcccattcctctagtaggaagttggagtagatgacctctaagccatttccaactcagaaatttttatgaatttatgattcaggcataggacagcccttacttgataacagtgtgagatcatgattaagctagacagcagtatagttgttttgttgttgacagcaaatccggtgcatatgttaaacccactgagtaattagaacaaaagagaaactgagtaggtagtaaaagtggtgtcttctccattttatttttggaagactagatcttcagtgcaagaaatcttccagtttctggccagccagtcaaggttgcattttaaaagggcgagtttatttttttatgcttatttatttatttatttatttatttatttatttatttatttatgagacagagttttgctcttgttgcccaggctggagtgcaaaggcatgatctcagctcactgcaacctccgcctcccgggttcaagtgattttcctccctcagtctcccaagtagctgggattacaggcatgcgccaccatgcctggctaattttgtattttttaatagacatggggtttctccatgttggtcaggctggtctcgaactcccgaccccaggtaatccacccgcctcggcctcccaaagtgctgggattacaggcgtgagccaccacgcctggccaatgacatgctaatttaaatactcttcattgataaaatagaggacatgaatctaatattatgaaatattattattgtcaggcttagtcatataaaattactttttctttgtctcttgtccaaaggattgtgattaagtaactgagaattgaaacttaaaatgattcaatcattttctgaattctctattgccttttgcaaataggaagcttgttggagcagccctgcttaaaggacatttattgcacagcaatttctataagctcccattgttcatgccttcaattcatccagtcaacagcattgactgagggatgtagaggaccaagtacttattctcagagctgagagacctggaaaaactaaatgttgcaatctgcacactgatagctactgccgcaaaaattaacactatgtaaaattacaaatttgtcccacactgctatgatagctctatgattgaaatgaataatttcactcttacttctttaatgaaggtttgcaatgatggaaaaacagtaggaagcattttttcaaatgcaaattaccttacaggaaagaaataacaaaggaaagcattgccaccaaggggaaaaattaaatcttacaccacttccttgggtgtagttgagacaaacagttagcatggtaaggatcatttatgtcctgtaataacatattactttaaaaatttccattccttccagttatgggtcctatctatttgctgggtgactttgatgttgcatgtcaggaactaactgtgagatatttttagcataattgcaaatctcatgaagaatcttcacaataaggattctaagtggtgtgtaattctcatccacaggttgaatgactaaattaagatacatacagatctgtcacttgcatgagatggtaaagttaactaatcagttaaatcattgttactttcttacgctgtacaaggcatagaggatgtagcaatgaacaagtagataagagagtggcctcaatagaacttacatttgagagagaaaatcccagacatacatatggaaaccccattattgatttcttcatatattcttaatatgctttgctatgtaacaaagcaccaccaagcaaccatttattagctcatgattctgtaatttgggcaggactgagctgagacagctgctctgtatggtgctggccggggtcgctcaactagggctggactcacagacaggtgagtgaaggcgacctcactcacctgtctgtgccccagttgggctggctctcgtggctggggcatggcagggcctctctctcttcctttggagtctctcaacttctggggtttctcgcttcttcatttggcctcattccctctagctgtgtagttgaacttctttgcaagtgacttccaagaaggtggaaaatggaagctactaagtttcttaaggcctagacccagaagtcatacctgaccccttccactgcattctgttggtcatagcaagtcccaaggccagtccaaatttaagaagagggaaatagattgtctcttgatgggaggaggggctatgtgcattcaggggtagggagaattgttggtgtccccttttatagataatctaccacatgcttcttcagaggtgaagagaaataatgtggcacctttttcaaatctttgctattcagttgctatcttgtctacaacagaaagaggaacgtgactacctttgaaaatagagtgatcccttttaatctctactctattcctttttttatgactacatttggaaaacaatttaacttctaagactatagtgacttttcaacaagtttccagataaaatatacatgatatatttactgacaggatcttttcaagccctgttctaggtgttcataaatatatagctatagcagataaaaaaatcatagcaatcttaaggctgaaagggactttagaaatcatctctttcacatccctaatttcagagagtagggcactaaggttcatatgtggtaataatgacaatgtttgttagaatttatattttctttgtctatttcaattggaaggtatgtttagattttttacagctttatgggtatggttattcgattgttattaccatggttactagaaagcagtttatcttggctttccattgaaaaaattaaaggattatgctctgagattcatgcttgtaattgtctccaaattatgtattaatgccatagatctctgagttatggtgctataggagtaattgtcggacatgaatttacacatggatttgataataatggtaagtaccggttcattttataagctgctgcttttataataatgttgactatatggatgttaattgttatgattatctttgcatagcagcagcatcatagcttgaagattatccaaagcaatatgattgctgattgaaaacttttcaccgtgtcttgctgtgatggcttgcaataagtaaacaattgttcccattggtgatcggggtagactttaaaaggcagccttgtaatttcaataaaattagctttgcatttagatcaggattgctgtagctgccacaatagttacagagattgatttatagcttctccctttgtcatttattcattgtcttgagatattctccctggaggagcaagctctgctccaacgatgattatacatgctgccaagttaggactcgttgagttaggactctggagcttggctgactggttcccttttacgatttcgaagattatgcaatgcttaatctatatttttctctatactggcttatattctgattattattattattattatcattattgagacggagtctagctctgtcgccaggctggagtgcagtggcacgatctcggctcactgcaacctcggcctcccgtgttcaagtgattctcctgcctcagcctcccgagtagctgggattacgggcacgtgccactatgcccagctaatttttgtatttttaatagagacggggtttcaccacattagccaggatggtctcgatctcctgacctcgtgatctgcccacctcagcttcccaaagtgctgggattacaggcatgagctaccgcgcctggcctattctgattattttaaagtctatactttcctgataatttatataataggatatgctttgtatcccgatgacatttaagcaaaaagaaaaagcagaatatgacataaactaaagaaatggcttcctttgagagtcctcatcatcattaatcagcactcttttctcctttaactttggagtattatcggaaggccacatgaaatctctgaaacttacggattagtagcaaattactatcacatccatacccacacagtgatttacaggcagtctcaggaaccagctgccctaaggcaacgttatatagaaggggacctctttcttccatccctgtagtatctccaacatccttcctggatgcctaccccagggccagagacacttaggctcttctagaaaagtcttcctgtactcccaccagcccttccttaatcacctagattttttgctcccctggtcttcccttctctgttaaaatgtggctgacttgtagttataaatgtggctgacttgtagttatctgactctgcagagctagactttctgcctttgggtgtttggtttatctgagatgagagtcttagctaagaaaaaaaaaagctaatagtcctttcttcgttctggacctctcttgataggaaatttaagtacagttcctccccagaaccttctggagtctttctcaaaggactgaatctaatggtggcaatttcactctgtaaccaatgcttagaacagtgcattgcacatataagtacatgcccggtacctatttaatgattggttggttagtgggtagaggacagtgactccatactatcccagggggtggtgttagtagtatgtagccttgctgaagagttttggattgttccaattaacaactttacttacgggacttttttgtaagctctctgtataattaaatttaaacgatgcctctgattctcatagtaaccctgaatatagaagacagtctagcagcatccaaattttgtttcaaaggctgtagagaaaatgaagagtgagcacatagcaagaaagcatgtgtaatctttcttcccattgtgttttggagattttcattcttattccaagttttctttttagagcaatcttccctgtctaagcaggacagatgggccttccgtccacactagtggctgtggaatgaatcataacagaggttttatgtgtctttcagctcctggcaacttggaggaaacaggttcctatagggctgagtcagggtctatgatcgcacagtatggatgactcactggggctattcctatggatcatttggaatttcactggtagtaatgctctgattgcctccatgggctttctgaatgaagccattttatttcataatccagtgaacactttgggtcaaatcaggtgaagacacagaatccaagattgaataagactagtatatgtaataaattgatgaatctcatttttaaggtgctctttgttccttagaaggaaagaacttcctcaattgtctttatcctttttgccctttttacaattaacctgtgacattggagagaatgcaggagctgatctcaggaagagtgttccctgctgttatgactgctttttgaaggcttgtcgaggtgagggaaaggaaagatgaatttagtttccataaataacacaaatgtcttcgaacttttccttttgctaggtagaaaatatgataaaaatggaaacctggatccttggtggtctactgaatcagaagaaaagtttaaggaaaaaacaaaatgcatgattaaccagtatagcaactattattggaagaaagctggcttaaatgtgagtacaactgtggctaaggggggcaccttgtggttcatttttcctcatttggacattagcttgctttaaaccattggttctcaaagcgtgtttacaagatcaacagcatctgtcttccttgggaacattcttgagtcctaccccatacctgctgaatcagaatctttggggttggggcctggtcatcccttaaccaggcatgaactttttcctgatatattactagggctggaaaaatacctaaatccttgctatgcctcaaatctattatacttgtagatgaatttaggtaaaaatccatgtgcttcttttaaagggaatgtttataaacactgacttggttctcctggttcttaaaccatgctcagcccaagtgagaccactgctcattcaggcagagaaaccagagtctgtatccttgaatggtgtctagctcttttatcagtgtcctggacagccatttctctgcctatatatttttaaatatctacaactgtgacatgagaagacctaaaatgggtgcttctatgtatctctatatagtgcaggggttttcacactgtgaaaattcatctggagtatatgttgcttcaagaaaagcatagcagaaaggggttctagagtcagacatgggtccaaatctaggttcaactagttttatgaacttgggcaagttacttaatgttcctgagtctcagcatcttcatctgtgaaacgggtcaatgtttctgaactcatggatttgttgtaagaattaagtgagcaaagcaatgtggagcactagcacaaggcctgacataaagcaagtgctcaataaaagatcgttagttaatattcctgatccttcgtgacatactcattagtaccctatcccaggaaaaaacaaagccaaagatttttgggttaaaaaccccccaaaaaacaatagaacagctttcttggaggaagggaatttatatttcctgatgattagtatatacaggcatgaagatgaaacttttcacttaattgaaacaaatgtatccccatactagtcctgagaggtatagattattactaagtgtacaggttttacgtatgaggttcaaaggaattaaactgaggttcaaagagattaaaatccacggtagagtctagattagagtttaagtaagtctgtacgactccaaagtccatactgcttcccctatatcatgctgaggttcttattttaagttcattttatatctgggtgatgtgtgggtggactgctcttcaccattcattttggccaaagtgtcagagattgaaacttaattctgacaaatgtgtacctttgtcacaaggacgatagaaagggcatgcctgtcttagcaccaatccacttaaccatcagaaaacagcttcagtttcattcccacaggagagtgggtggcttcctttgtggatataagggccatgctttattatttttctggcttcatttataggagccgttcctttgtgcctgaatcttgctttgtagtgacttcgggggagctcagatggggcactacagatgcagactgtcagcagctgttgagtctttttttgttgttgttccttttcgtagctgttgagtcttgggagtccaaacctagggccacgtggtctactgaggcagaccagagttcaaggagccagaggggtgaggctgctccaaaaggctctaaattagatataaagcttagagtgaatggctgggcatggtgactcatgcctgtattctaaacactttggaaggccaaggtgggaggatcacttgaacctaggattttgataccagcctgggaaacatacggagaccctgtctctacagaaaattttttaaaaaattagccgggtgtagtggtgcatgcctgtagtcccagctactcaggaggctgaggtggaagaattgttggaaccctatagtgagatatgatcacaccactgcactccagtgtgggtgaaagagagagaccctgtctcaaaacacacaaacacacacgaaaccctcagagtaaaaaggaaggagattaaattttttaagcaggagtggatataatcataatcttcaagagccaagaggagttgggacttgagaaagtagcatattaggaagcaaaggctctggagacagaagactgcttgggttcgaatcccagtgacatgcgagcagtttacttcatcactctgtcttaggttcactagaagcagagcccaagaaggggttccttaggtcattgacttttttgagacagcgtctcgctgagtcacccaggctggagtgcggtggtgtgatctcggctcactacaacctctgcctccctggttcaagtgattctcctgcctcagcctccccagtagctgcgattacaggtgccagccaccacgcctggctgatttttgtatttttaatagatacggggtttcttcatgttggccagtctggtctcaaacccctgacctcaggcaatctgcccgccccagcctcccgaagtgctgggattacaggtgtgagccaccgcacccagcccaggtcagtgatttattcagaaagtcgtttcaggaaaaacctataatggaatgagggaaacctattggtttcaggaaatgtttagcctcaccctgattccacagaggattctggagcacgaactgcaccacagaaattgttcagcccaggtactgggttgttcaaactgcacatcagtcaattactggaaggtgggttataacctcccagcggtctccagatgaggtgactcccataagctaaggttgatctgagctgttagcagttgtgggaatgggtgcacagtttaggcagaaaaggggatctggtgggatatcgacatctgctacactctcggagctttagatcctcatttgttgagcaagggtggtggtaattagcacttacttacctcatacgactgtggataacaaagaatatacgtaaagcaggaatggtagcttttgtgtactgaagctaggagggtcctgagtgattacagtgaataatattttccaaagatttgtttttattcattgatattgcttgatacctgggtgactgggctagcttaaaagtaaagtgttggtaagatccatggcttgaaagttaaaagcaaggtatattagttttctgttgcttgctataacaagttactataaacttagtagcttcaaataacataaattatcatacagcgctgtatgatttattatcatacagctctgtatgtcagaagtctgacatggatctcagtggactaaaatcaaagtgtcagcagggccacattcctttgtagaggttctaggggagtatctgtttcctcgccttttctagcttttagaggctgcccacattccttagctcatggccccttcgtttttcaaagccagcactggccggtggagtcttctcatgttgcatcactctgacactcgctctcctgcctcccttttcctcttgtaagaacttttgtaattacactgggtccacctggacaatccaggataaagtctgcatctcaggatccttaatcacatcataaaagtctcctttgccatgctttatttttccagcttcattttgtggggaccattcctctgtgcctgaatctttctttcttcgcagtgaataaggtaacatattcacagattccagggatcaggacgcagacatctttgggaggccgttatcctgcgtgttatacaagagttgaatgacttttctgtaaagggccagatagtaaagaattgaggctttgtggggcgtatggtctctgttacaatatttaattctgccactgtagcaagagagcaaatacagactatatgcatgggcatggctgtgtcccaataaaacttgatttatgaacaccaaaatttgaatttcatataagtaattttcatgtgccaccacaatattattcttcttttgatttttccccagttgttgaagtatgtaacatccagtcttaccttgaagcctgtacaaaaacaagcagcaggttggatttggcgtgtgggctgtattagtttagaatatttgtgtcctagctcatttaaagttttgagaaacaatcttgaatattgggaataattttttttaccatgctggctggttgtcatacatatcgcagacctcgaccttgtgatctgcactacttctgtttgatttttcttccctaggagaaccactttccttttaattttccatggaaattgctgaaggtaaaatgatgatagttggtcttgaaatcttgttcctgtgtggatggtaaatttttggaaacacaggcacaatgagaagaatactcaaattatgtgagttaatcagagaaagtaacctgtgtattgacattcctgttttttcccattaaaccagagtcactcagaatattgttaacattttattggagctggctagattggttagaatgaagaggtaggtgaaaaagaagtgtgtagcataatgaaatagaaagtattacattccagagcaccttgctgaggatagtttgccatctttcttacaatatattatgcctacctctgatttattgaatgtgattttctctttaaaatatgatacttttcttgctataatattgatgcctcttgctgaatgatagttgaccgtgaaacacgcattcattttttttttttccttttttctttctgttaggtcaaggggaagaggaccctgggagaaaatattgctgataatggaggcctgcgggaagcttttagggtatgcgctgctacatttaccgtggttctaaaaatcaagccataaaacaccatatgggggtacctcaattcataccatagccatgttcttgaggagttagttagttagatattatggaatttctgtaaatagaagtgtgtctccccattgaccctattacataaagagaactatatttcttttttctttttggggtgtgaagtcaccctaaagaataatatttgttattaagaatcatgtatttaaagaatagcttttagaaaatacattcaccatcagatcgaagcatgctacagcaatctccttggggctaggttcatttgttttccttgagtacaggtctttctgtagtcctcctataaatttctcttaaaatatcaaacttctaaattatgaccagagggtagtggttctcatatactgggccaagtgatagttcataataacgttttcatcatccactagtttgtggtcaaataagaagcataaagataatacagaaagatttcataaagctaaatgcattaaatttaatgactagactgttattcctggttatatccttcctatattctagttgaaatatactttattttataaaatgagggcactagaagatgataggttttctcttacgtgtcaaaatgaaaaaaggtaatatgcggaccccaaaatgtattgccataggggccttgccattgtgttagatttgtttgtcccctgctaggaatggaaagaacagctttttttctccaagagttatttaacatctgaatgctttggtccagctgctttggtatacattgagcataaggcctttttgcaggtgtacctgcctcactggtaagcaacaggacatggacttgtgtttcttaagaaaattttgacatgatgcattttgcacgtggcaggagtatatatttgctattcctgtgctagctgagcaaagagaaaaacccaccgttgcagagactcatctcttcttcttctctcaccaggcttacaggaaatggataaatgacagaaggcagggacttgaggagcctcttctaccaggcatcacattcaccaacaaccagctcttcttcctgagttatgctcatgtgagtagactgaggaaggggcatcagggatgagatgcaggacttgagtttgctcccttgatcaaagaaagatttcaaacaaaagtttaatggcatgactttgattttcagcaaaaatgttatcttgattattttcagggtaaatctcatcttcttaatgttctgtagtacataattaattaactgattgaatcaaggtttattagtattttttaaatcaaatgggttagcagccctgtggtaattcatttgatagttcctcaatgtatcttgacttcttaatgtgtttgatactatttatttgtaaccatttctagtaacttgctctttggctttcatgggcctgctctttcctatattgctcctcctttgcctcatttgctgactttatgccaccactctcagcctgtgggggaccctcagggtcatgttcccaactgtctaatgcatatgcagagacccctagagctgaaaaagaacaaaggcaaggagagtcatgtcactcttttgtgagtttaataggctcttggagcagaaattgaaaggaagatgtacacgaaataaagcacagttccgagcctgagtctctgtctaatgaggcaagtgccaaatctttattagctattatactggtttatgtcataaacatacgggcagccttttcaaagaagtcagggataggtcaataaaggttctagtgaatggcctcaccgtgggcaaatgtgtatgaatatgctcaaagctagacaaaaattttcatcagtacaaccttttgttcctaagtctgtctttgctttcactgctaagtaagctcattctcacacgagtcttctataattcactctggtcacaggattcttgcttgcctgcggtcttttatttcttaaagctaataaaaaacactaaataaattattatttagcaacctaatgtcaacaaaactcaactctagtcatccacaacatgactttccttttacttttcctgtttctatcatcacatcccatctttagattttcctggttagaaagcctggattcttaggtcttatttgatgcatctgtcctcaattttacaacatgtattccagaagccagatgtttcatactttactttactttaaaaaaaaattatactttaagttctggggtacacgtgcagaacgtgcagttttgttacataggtatacatgtgccatggtagtttgctgcacccatcaacccgtcacctacattaggtatttttcctaatgctatagctcttctagcccccaaccaaccctctgacaggccctggtgtgtgatgttcccctctctgtgtctatgtgttttcattgttcgactcccactcatgagtgagaacatgcggggtttggttttctgttcttgtgatagtttgctgagaatgacggtttccagattcatccatgtccctgcaaagaacatgagctcatccttttttatggctacacagtatgccatggtgtatatgtgccacattttctttatccagtctagtctatcactgatggacatttgggttggtgccaagtctttgccattgtgaatagtgccacaataaacataagtgtgcatggcatctttctttatagtagcatggtttataatcctttgggtatatacccagtaatgggatggctgggtcaaatggcatttctggttctagatccttgaggaatcgccacactgtcttccacaatggttgaactaatttacactcccaccaacagtgtaaaagtgctcctatttctctacatcctctacagcatctgttgtttcctgactttttaatgatcaccattctaacaggcatgagatggtatctcatagtggttttgatttgcatttctctaatgaccagtgatgataatgagcatttttcatatgtttgttggctgcataaatgtcttcttttgagaaatgtctgttcgtagcctttgcccactttttgatgaggttgtttttttcttgtaaatttgtataagttctttgtagattctcgatactagccctttgtcaaatggatagattgcaaaaattttctcccattctttaggatgcctcttcactctggtggtagtttctttggctgtgcagaagctctttagtttaattagattccatttgtcaattttggcttttgttgccattgcttttggtgttttggacatgaagtctttgcccatgcctatgttctgaatggtattgcccaggttttcttctaggatttttatggctttaggtcttaagtttgtttaagtctttaatctatcttgagttaatttttgtataaggtgtaaggaagggatccagtttgttttctgcatatggctagccagttttcccaacatcatttattaaatagggaatcctttccccattgcttgtttttggcaggtttgtcaaagatcagatggttgtagatgtgtggtgttatttctgagggctctgttctgttccattggtctatatatctgttttggtaccagcaccatgctgttttggatactgcagtcttgtagtaaagtttaaagtcaggtagtgtgatgcctccagctttgttctttttgcttaggattgttttggctatatgggctctttttttttttttttttttttttttttttttttggttccatatgaagtttaaagtagttttttccattctgtgaagaaagaaagtcaatggtagcttgatggggatagcaatgaatctctctctaaattactttgggcagtatggccattttcacgatattgattcttcctatccatgagcatggaatgtttttccattggtttgtgttctctcttatttccttgagcagtggtttgtagttatccttgaagaggtcctttacatcccttgtaagttgtattcctaggtggtttattctcttagtggcaattgtgaatgggagttgactcatgatttggctctctgtttgtctgtgattggtgtataggaatgcttgtgatttttgcccatcgattttgtatcctgagactttgccgaagctgcttatcagcttaaggagattttgggctgagacgatggggttttcttaatatacaatcatgtcatctgcaaacagagacagtttgacttcctcttttcctatttcaataccctttatttctttctcttgcctgactgccctggccagaacttccaatactatgttgaataggagtggtgagagagggcatccttgtctggtgctggtttccaaagggaatgcttccagtttttgcccattcagtatgatattagctgtgggtttgtcataaatagctcttccaattttgagatacgtgccatcaatacctagtttactgagagtttttagcatcaaggggtgttgaattttgtcaaaggccttttctgcatctattgagataatcatgtggtttttgtcattggttctgtttatgtttattgatttgcatatgttaaaacagccttgcatcccatgtatgaagccgacttgatcatgtgatggataagctttttgatgtgctgctggatttggtttgcaagtattttatcgggtattttcgcatagatgttcatcagggatattggcctgaaagttttctttttttttgttgtgtctctgccaggttttggtatcaggatcatgctggcctcataaaatgagttagggaggattccctcttcttctgtggtttggaatagcttcagaaggaatggtaccagctcctctttgtacctctggtagaattcggctgtgaatctgtctggtcctcaactttttttggttggtaggctatcaattgctgcctcaatttcagaacttgttattggtctattcagggattcaacttctacctggtttagtcttgggagggtgtatgcgtccaggaatttatccatttcttctagattttctagtttatttgcatagaggtgtttatagtattctctgatggtagtttgaatttctgtgggattcttggtgatatcccctttatcattttttattgcgactatttgattcttctctcccttattagtctttcttgctagtggtctatctgtgttgttgatcttttcaaaaaaccagctcctggattcattgattttttgaagggttttttgtgtctctatctccttcagttctgctctgatgttagttatttcctgttttctgctagcttttgaatttgtttgctcttgcttctctggttcttttcattgtgatgttagggtgtcaattttagatctttcctgctttctcttgtgtgcatttagtgctataaatttctctctacacactgatttaaatgtgtcccagagattctggtacattgtgtctttgttctcactggtttcaaagaacatctttatttctgccttcattttgttatgtacccagtagtcattcaggagcaggttgttcagtttccatgtagctgtgtggttttgagtgagtttcttaatcctgagttctaatttgattgcactgaggtctgagagactgtttgttatgattttctttctttcttttgcatttgctgagaagtgttttacttccaattatgtgatcaattttacaataagagcgatgaggtgctgagaatatatattctattgatttggggtggagagttctgtagatgcctattaggtccacttggtccagagctgagttcaagttctggatatccttgttaattaattttctgtccatttatctaatattgacagtggggcgtaaagtctcccacgattattgtgtcggagtctaagtctctttgtaggtctctaaggacttgcttgatgaatctgggtgttcctgtatagggtgcatatatatttaggatagttagctcttcttgttgcattgacccctttacgattatgtaatgctcttctttgtctcttttgatctttgttcatttaaagtctgttttatcagagattaggattgccacttctgcttttttttttttttttttttttttttttttgctttccatttgcttggtaaatattcctccatccctttatttattttgagcctatgtgtgtctttctttgcatgtgagatgggtttcctgaatacagcacattgatagttcttgactctatccaatttgccagtctgtgtcttttaattggggcatttagcccatttacatttaaggttaatattgttacgtgtgaatttgatcccgtcattatgctgctacctggatattttacccattagttgatgcagtttcttcatagtgttgatggtctttctttacaatttggtgtttttcagtggctggtgccagttgttcctttctgtgttcagtgcttctttgaggagctcttgtaaggaaggcctggtggtgacaaaatctctcagcctttgcttgtctgtaaaggattttatttctcctttgcttatgaagcttagtttggctggatatgaaattgtgggttgaaaattcttttcttttctttgagattgttgaatattggccctcactctctcctggcttgtagagtttgtgctgagagagatccactgtttgttagcctgatgggcatccctttgtgggtaacccgacctttctctctggctccccttaactttttttcctccatttcaaccttggtgaatctgacgattatgtgtcttggggttgctcttctcgaggagtatcttagtggtgttttctgtatttcctgaatttgactgtgggcctgtcttgctagggaggggaagttctcctggataatatcctgaagagtgttttccaacttggttccattctccccgtcactttcaggtacaccaatcaaacgtagatttggtcttttcacatagtcccatatttcttggaggctttgttcatttcatttcactccttcttctctaatcttgtcttctcgctttatttcactgagttgatcttcaatctctgatatcctttcttccgcttgatcaattcggctattgatacttgtgtatgcttcacaaagttctcatgctgtgttttttagctccatcaggtcatttgtgttctcctctaaactggttattctagctagcaattcatctaacctgttttcaaggttcttagcttccttgcattgggttagaacaatgctcctttagctcggagaagtttgttatcacccaccttctgaagcctacttctgtcaattcgtcaaaatcattctccgtccagttttgttcccttgctggcgaggtgttgtgatcctttggaggagaggaggtattttggtttttgtaacttttagcctctttgtgctggtttctccccatctttgtggatttatctacctttggtctttgatgttggtgaccttcggatggggtattttagtagacgtgctgttcctttctgtttgtttgttagttttccttcttacaaacaggctcctctgctgcaggtctgctggaggtgcactccagactctgtttacctgggtatcaccagcagaggctgcagaacagcaaaaattgctgcctgttcttccctccggaagctttgccccagaggggcacctgccagatgccagccagagctctcctgtatgagatgtttgtcggcccctaccgggaggtgtctcccagtcaggatacacgggggtcaggtacccacttgaggaggcagtctgacccttagcagagctcgaccactgcgctggctgtcaggcagggacgtttaagtctgctgaagctgtgcccacagctgccccttcccccaagtgctctgtcctagggagatgggagttttatctataattccctgactggggctgttgccttttttttttagagatgccctgcccagagaggtgacatctggcagtctggccacagtggccgtgctgagctgtggtgggctcctcccagttcaaacttcctggtggctttgtttacactgtgagggtaaaaccacctactgaagcctcagcattggggaacgccccttccccccccaagctcaagtgtcccaggtcaatctcagactgctgctgtactggcagcgagaatttcaagccagtggatcttagcttgctgggctctgtgggggtaggacccgccaagccagaccacttggctccctggctttagaaccccttctgacgggagtgaacggttctgtcttgctggcgttcccagcaccagtggggtatcaaaaaaaaaaaaaaccacacacacacacacagaaaaacaacaacaatgaaacaacaaaaaactcttgcagctagttgggtgtctgcccaaatggccacccagttttgtgctggaaacccagagccctggtggggtaggcactggagggaatctggaatctcctcctgttctgcaggttgcgaagaccgtggggaaagtgcagtatctggactggagtgcacggttcctcaggctcagtccctcatggcttcccttgggtaggggagaaaattccccgaccccttgcacttcctgggtgaggtgacaccagaccctgcttcggcttgccctctgtggcctgcacccactgtccaaccagtcccaatgagatgaactgggtacctcagttggaaatgcagaaatcacccacttactttctgcattgatttggcattgatttcgctgggagctgcagtccagtgctgttcctatttggccatcttctagttcttctcgatgtttcatacttttaagtgcttttcagatttgacatcttctctcctgttttagacagtttgggctgctataacaaagtgtcatagactaggtggcttatgaacaacagaaatttatcacagttctggaggctggaagtctgcgatcagagtgctagtgggatcgagttttggtgagggctttcttctgggttgcacactgccaatttctctctgtgtcctcacatggtggaaagagctagctagctctctggcctcttcttataagggtactaatcccattcctgagggctccaccctcatgatttaattgcctcccaaaggcccaactcctaatgccatcacattgatcagggcttcaacataagaattttgggggatagaaacatttagtccatagcatccccattaccctatcttatcatatatagttagttatcatatataggcataatcttaataaatatcctctactctggattatcccaacagccttatggaatgttaatctgacttcagcatttttttttttaaccactgttatacataccattggaataccacttttatttcattaccaacctgctgaaagaactacagtggctcccaaatgcctaccacattgaagccaaatacctccatctggcttcccaaattttcagtatgatccaactccactcaatccaattcaatttcccataactaactccactgggtgagaaaaaactcagccttagtggggcaagtatcctcacttctaccctacaatgtcatgcccattactgtctctttggctttgcttctgattctccttctataatgcaacccttcctactcttccccttcagatgattattcaatctaagcttcatccttcaggatccatgttgagttccactccctccacatcttccataaactcttccccaaggaccccagtccttattattttcttttatcttcaactccttttatctttcttactttcattaccatgcagttgagtacttaactgctctccaaatgttcaagaattttagttttatctccacagctaatcttctggatccttacacttcctatctccatagcacccagcaaagatgctgggtatattgaagacagttgatatttttagatcaattgcttgaaatgactaaaactaacagttcaactaaggagactcccttttactgggtcagatatataaaataagtatacaaaaatagaactttctagagttgggattggcaaactagggccaaatatggcctgctgcctgtttttgtaaataatgttttattggaaagcagccacattccttcatttattcatgatctgtagctggttttgtactacagtggcagagttgaataattgaaacagggaccttatagtcttcaaagcctaaaatctttaccatctgtctcttttcagaaaaagtttgctaacccctgctctagaggacaaagtatagtgatctatcaatcagttcttactatttacatcctagcccacaatatctctttgtagataaaataaactaattgattgatagtgaagttacttataattctgaaatgtttccagatataataccaaactaaactatagctgactgatttattgtaaactaaagagatagatagatagatttaggggggaaaagtggaaagctattttatatcttatatcactagtgagaaatttatcttggagcttttcccactgacagaatgaagagatttttcagtcttttgcactttaaagtaagtctgcttataaggagtaaaattactttccctcctgggaaggtactaagaaaacagtagcaggcataatgtgttttcagaagtctcttaagtgatatattaagcaaagacaatactatattagagtataagaatataggaagaaataagaaatgaggtaaaatcaaatgccagaaacaacttcatattagccagcttctgaggaaatcaagggatcgcattacaaaacatcatcttcaaagtcaaattcagaaccactgtgactggtggtttatcttcatcaaaagcaacaacatcatatcacctttcctgctttctatgtccctgtagttgctgtgacctctcatttttctcagatattcttctaatccttctacttctttccattctattttctacttatttagtggacatccattgagaaccttcctggtatctataaataatctaactagcctctaatttcttccttccactatacacccctgccagataaatctttttcaaaatctgggttttattattttcctactcaagaatgacttttaaatatagtttaaacgctctgaccaactgctcaggacttcagaaatctgacactgtccttcctctcccactgctgcccgttaggcatcatatactccagcctagctgaatgtctggttctctttcccctcaaacatgtctttgttcccatttccccctccacttagaatatttttttccatatttatgtgtcctagttcaattcacacttgaagaccatatcatacctcaagtcatatggcaagtcaggattaaagtaagtaagttatgctgcagaaacaacacgacaaagtttatttcttgttcactctccatgtccaacatgagtcagcagtggggctcttgtagtttttcatcaagaagttgggttttgggccgggcatggcctgtaatcccagcactttgggaggccgaggcgggtggattgcctgaggtgaggagttagttagtttgagaccagcctggccaacatggcaaaaccccatctctactaaaaaaatacaaaaattaggcaagatggcttaataggaacagctctggtctgcagctcccagcaggattgacacagaaggcgggtgatttctgcatttccaactgaggtacccggttcatctcactgggactggttggacagtgggtgcagcccacggagggtgagccaaagcagggtgggacgtcacttcacccgggaagcacaaggggttgggggatttcctgttcctagccaagggaagccatgagagactttaccaggaggaacagtgcactccagcccagctactgcgcatttcccacagtcttcgcaactggcagaccaggagattccttacagtaccgggctcggtgcatcccacccccatggagcccagcaagctgagatccactggcttgaaattgtcactgctagcacagcagtctgaagttgacctgggatgcttaagcttggagttgggaggggcatccgccattgctgaggcttgagtaggctgttttaccctcacagtgtaaacaaagccactgggaagtttgaactaggtagagcccacagcagttcagcaaggccactgtgaccagactgcctctctaggcagagcatctctgaaaagcagcagccccagtcagggaattataggtaaaacccccatctccctgggacagagcatctaggggaaggggcagctgtgggcacagcttcagcagacttaaacgtccctgcctgacagccagcacagcggtcgagctctgctaagggtcagactgcctcctcaagtgggtcccggacccccgtgtatcctggctgggagatacctcccagtaagggctgacaaacatctcatacaggagagctctcactagcatctggcaggtgcccctctgtggacaaagcttccagaggaaggaacaggcagcaatctttgctcttctgtgtagacttcactggtgatacctagccaaacagggtctggagaggacctccagcaaactccagcagacctacagcagaggagccctgagttagaaggaaaactgacaaacaaacagaaaggaatagtagcaacatcaacaaaaaggatgtccgatcagagaccatatccgaaggtcaccagcatcaaagaccaaaggtagataaatccacgaggatggggagaaaccagtgcaaaaaggctgaaaactccaaaacccagaacgcctcttctccttcaaaggatcacaactcctcgccagcaagggaacaaaactggacggagaaagaatgattttgatgaattgacagaagtaggcttcagaaggcgggtgacaacagactcctccgaggtaaaggagcatgttctaacccattgcaaggaagctaagaaccttgaaaacaggttagaggaactgctaactagaataaccagtttagaggagaacataaatgacttgatggagctgaaaaacacagcacgagaactttgtgaagcatacacaagtatcaatagccgaactgatcaagcggaagaaaggatatcagagattgaagatcaactcaatgaaataaagtgagaagacaagattagagaaaaaagagttaaaagaaatgaacaaagcctccaagaaatatgggactctgtgaaaagaccaaatctacatttgatgggtgtacctgaaagtgacggggagaatggaaccaagttggaaaacactcttcaggatattatccaggagaacgtccccaacctaacaaggcaggccaacattcaaattcaggaaatacagagaacaccgcaaaaatattcctcgaaaagagcaacccaagacatataatcatcagatttaccaaggttgaaatgaaggaaaaaaggttaaggggagccagagagaaaggtcgggttacccacaaagggatgcccatcagactaacaaaggatatttcggcagaaaccctacaagccagaagagagagggggcaagtattcaacaatttcaaagaaaagaattttcaacccacaatttcatatccagccaaactaagcttcataagcaaaggagaaataaaatcctttacagacaagcaaaggctgagagattttgtcaccaccaggcctgccttacaagagctccgcaaagaagcactgaacacagaaaggaacaactggtaccagccactgaaaaacaccaaattgtaaagaccatcaacactatgaagaaactgcatcaactaatgggcaaaatatccaggtagcagcataatgacaggatcaaattcacacataacaatattgaccttaaatgtaaaggggctaaatgccccaattaaaagacacagactggcaaattggataaagagtcaagacccatcagtgtgctgtattcaggaaacccatctcacttgcagagacacacatagactcaaaataaagggatggaggaagatctaccaagcaaatggaaagcaaaaaacaaaaacaaacaaaaaaaaaacagaggttgcaatcctagtctctgataaaacagactttaatccaacaaagatcaaaagagacaaagaaagaagagcattacataatggtaaaggggtcaatgcagcatgaagagctaactatcctaaatatatatgcacccaatacaggagtacccagattcataaagcaagttctcagagacctacaaagagacttagattcccaaacagtaacagtgggagactttaacaccccactgtcaacactactgccaacactagacagattgagacaaaattaattaacaaggatatccagggcttgaactcagctctggaccaagtggacctaacaggcatctacagaactgtccatcccaaatcaaatcaacagaatatacattcttctcagcaccacatcacacttattccaaaattgaccacatagttggaggtaaaacacttctcagcaaatgcaaaagaatgaaaatcataacaaacagtctctcagaccacagtgcaaacaaattagaactcaggattaagaaactcactcaaaactccccaactacatggaaactgaacaacctgcacctgaatgactattaggtaaataacaaaatgaaggcagaaataaagatgttctttgaaactaacgagaacaaagacacaacgtacctgaatctctgggacacatttaaagcagtgtgtagaaagaaatttataacactaaatgcccacaagagaaagcaggaaagatctaaaattgacaccctaacatcacaattaaaagtactagagaagcaagagcaaacaaattcaaaagccagcagaaaacaagaaataactaagatcagagcagaacggaaggagatagagacatgaaaaacccttcaaaacatcaatggatccaggagctggcttttcaaaaagatcaacaaaatagaccactagccagactaataaagaataaaagagggaagaatgaaatagacgcaataaaaaatgataaaggcgacatcaccaccgatcccacagaaatacagtctaccatcagagaatactataaacacctctatgcaaataaactagaaaatctagaagaaatggataaattcctgggcacatacaccctcccaagactaaaccaggcagaagttgaatccctgaatagaccaataacaagttctgaaattgaggtagcaattaatagcctactaaccaaaaaaaagttgttgaggaccagacaggttcacagccgaattcgaccagaggtacaaagaggagctggcaccattccttctgaaactattccaaacaatagaaagagagggaacccttcctaactcattttatgaggccagcgtgatcctgataccaaaacctggcagagacacaacaaaaaaagagaattttagaccaatatccctgatgaacatcaaggcaaaaatcctcagtaagatattggcaaactgaatccagtggcacatcaaaaagcttatccaccacaaccaagttggcttcatacctgggatgcaaggctggttcaacatatgcaaatcaataaacataatccatcacatacacagaaccaatgacaaaaaccacacgattatttcaatagatgcagaaaaggcatttgacaaaattcaacaccccttgatgctaaaaactctcaataaactaggtatcgatggaacgtatctcaaaataataagagctatttatgacaaacccacagccaatatcatactgattgggcaaaaactggaagcattccctttgaaaaccagcacaagacaaggatgccctctctcaccactcctattcaacatagtgttggaagttctggccagggcaatcaggcaagagaaataaagggtattcaaataggaagaaaggaagtcagattgtctctgtttgcagatgacatgatggattgtatattaagaaaaccccatcgtctcagcccaaaatctccttaagctgataagcaacttcagcaaagtctcaggatacaaaatcaatgtgcaaaaatcccaagcattcctatacaccaataacagacaaacagagagccaaatcatgagtcaactcccattcacaattgccactaagagaataaaatacctaggaatacaacttacaagggatgtgaaggacctcttcaaggagaactacaaaccactgctcaacaaaataaaaagaggacacaaacaaatggaagaacattccatgctcatggataggaagaatcaatatcgtgaaaatggccatactgctcaaggtaatctatagattcaatgccaaccccatcaagctaccaatgactttcttcacagaattggaaaaaacttactttaaacttcatatggaaccaaaaaggagcccatataaccaagacagtcctgggcaagaagaacaaagctggaggcatcacactacctgactttaaactttactgcaaggctgcggtaaccaaaacagcatggtactggtaccaaaacagatatgtagaccagtggaatagaacagagccctcagaaataacaccacacatctaccaccatctgatctttgacaaacctgacaaaaacaagaaatggggaaaagattctgtatttaataaatggtgttgggaaaactggctcgccatatgcagaaaactgaacctggaccccttccttacaccttaaacaaaaaatcaactcaagatggaccaaagacttaaatgtaagacctaggaccataaaaatcctagaagaaaacctgggcaataccattcaggacataggcatgggcaaggactttatgtctaaaacaccaaaatcgatggcaacaaaagccaaaattgacaaatggaatctaattaagctaaagagcttctgcacagcaaaagaaactatcatcagagtgaacaggcaacctagaggatgggagaaactttttgcaatctacccatctgacaaagggctaatatccagaatctacaaaggacttacacaaatttacaagaaaaaaacaaccccatgaaaaagtgagtgaagggtatgaacagacacttcttaaaagaagacatttatgcagccaacaaacatatgaaaaatgctcattttcactggtcattagagaaatgcaaatcaatcaaaaccactatgagataccatctcatgccagtgagaatggcgatcattggaaagccaggaaacaacagatgctggagagaatgtggagaaataggaacgcttttacattgttggtgggagcgtaaactagttcaaccattgtggaagacagtgtggcgattcctcaaggatctagaaccagaaataccatttgacccagcaatcccattactgggtatataccgaaataattttaaatcactctactataaagacaccatgcatacgtatgtttattgcggcactgttcacaatagcaaagactgggaaccaacccaaatgcccatcagtgatggactggataaagaaaatgtggcacatatacaccatggaatactatgcagccataaaaaagaatgagctcatgttctttgcagggacatggatgaagctggaagctatcattctcagcaaactaacacaggaacagaaaaccaaacaccacatgttctcactcataaatgggagttgaacaatgagaacacatggacacagggaggggaacatcacacaccagggcctgtccagggggtcgggggctaagggagggatagcattaggagaaatgcctaatgtagatgacgggttgacgggtccagtaaaccatcatggcacatgtatacctatgtaagaagcttccacgttctgcacatgtaccccagaatttaaagtataataaaaaaaaaaatacaaaaattagctgggcgtggcggtgtgcacctgtaatcccaggtacttgggaggctgaggcaggagaatcgcttgaacccaggaggtggaggttgcagtgagccaagattgcgccattgcactccagcctgggtgacggagcgagactccatgtcaaaccaaacaaacaaacaaaaaacttgggttttagagtctatatcttggcatgtgcttctgtggataccacaggagtagaaaagacatacgaggatatgtgcactggccgttagtgtagcatcttaaattgttcttaaggctcttaaaacttctgtcaggttttaaagcttctgccaggaagtaacatatattacttctgcttctgctcacacttcattggccagaacaagccatatcgccatgcccaacttcaaaggagatggagaagtgtacttcagtcctaggcccagactagggtgaagcgagcaaggcactcaggggcagactactaacttctcatcaccatcctcaataatgggtggctgactcattttattgatttgaatgagtatggttaaatttgagaaggactatttcaaacattaaattcattgaatgaatacactggtcgattcctgggcacatatacgattctcttgatttaaagcacttgtctggaaacctttctcacttactcaaattgtgaaattattcacattgataaaaccttctactctggggatcagaataatagatgttattacagatgacggttttatttgatcttctaaaactgtttgtcatccattggttctaaaattgttcctcagtataatttggagcagttaaaacagcagaaaatacataattggaatgaaagctcatttgttgggatgcttttctcttctaggtgaggtgcaattcctacagaccagaagctgcccgagaacaagtccaaattggtgctcacagtccccctcagtttaggtaaatgggcaaatgggtgacggcagtttttaactgtacatctccccccttcctcccccacccagccatccaagggctctaccagataggtgatctgaaaaaaatcccacattgtggacgtgtgatttccattttgcagccaaaaaatatctggccacacggaaactaaatatcttctttcattagtagtaagctggtttagtcagcactctctcacctgaatttctgctgatggtacctgtacatatctagtctagtgctacatcaagtgccagtgagactatacaagactccagaggtaattcggaatccgaatcatagctttagtattacatcccattatcttctagtttttgaaagagtctcagtaaactgcattattggacttactcaactgcttacttttttgtccaaaaaaatagcctttattgtcttaggaaaggatgagatttgatgtactctgccttaaaacacctagcgctctggtttattttgttttaaagaatatcccctttaatacctcttgttctttcacacagtcaaccagcaaacatgaatgaatggccactttctaaatagctctgaacacaaaggaggatacaaagtattattcagcaattataatttatatctagagttagagagtctacattttggctttcaggtgggatcatattttgaaacggtagcttatacaaaaaaggaaaaggattatgaattgcagtcttatttgtcagaatgtataaaacattaagtacaaataaaattaaaagttaatattactcaccctgtactcggtcgtacaggttgacagaaattttctatagtaccggaaagataagtatgatgagaaacccaaaaaccataataatttatatgtattcattctttgtttagggcattatatctggatatctttatatttaatgtttaaacagatccattagcatattgcaagaaagccatctaaaatttcttctatatgttaaaatcttattcttaagatcttgccttagaaatgcttcagaaattgactataaattacccactagcataaaaatctaatcactatgttggaaatttctcccccactgggctaaactgtcatgaaggctgacggtctcgaacgtactaaaatgtgttcccactgaccaatggtgcagatgaactcacacagtagattaattactcaacagataagttttcagaaacttatttcctttaactagttgcctgtaatgttgaattttacagtgcatgcttactaattatcaactgtattctatctttaacacttgcctagggtgaatcacactatgaaatatgcatccctacccatatattcagctaaaacaacaagaggttatgaggattttttggatacagtccattacatttatgcaaatgcccgtaggtaacaaagtcattagggaagaaatagtcagggactgagaatgctgagtctctagtcaaccctttgaacacggagttgagtaagaaatagaaggggggaagttttttgtgtgtgtgtgtgctggcttgttactgaggtctgcagtaactatagattttgagtgcagcagaaatcacacaatggcaataccacttccaaaaggcagctacaatcaaagtgctgagtaggaatccagtctttgctgtagttggaagcctgtaagaatgtgacatattggagctaactccagtgaagaattatcagtaataactagataccattcattaattgactgattgttgcattaatcaaattctgggcaactgtgagcttcccatacctaacactaattcagagaaaatgttttgcagattgaatgaattctttaaaaatagctggaaatgcaacaacatggatgactcttatagacattatattcagtgaaagaaatcaaagaccaaacagtacataccatggattccattcacatgaagttcaaaatcaggcaaagctatggcaatagaagtcagaatagtaggttatcttgggagatgctgttggtatggaacaggcaggagccttctgggtgctggaatgtcttgatctggcagatagtaatatgggcatatacacacaaaaactggcaagtcctacgtttaatattttgcatactttatgtcagttatactttccataaagtttttaaaaagttagaaaaactaatattggtgatgatacagttttaaaagaattttgaagactgttcgaagagtaataggggcatgtgcttggcattcaggagatgctggatctagtctgttaattttttctggaaatttacttaatcattttgggctttagttgtctccctgtaaacagattaaaagaatgccaaccttctttctagcaatattctgctacagttttatacagaacctgttgatgtgcaagaattatatgacatatgctttgacatatcgtttttcagggtcaatggtgcaattagtaactttgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggagactttcatttttagtgcattttcattatttgggtaggtgacctgcttggatctagacagcatctgttcaaagttgtagggcttataaagtggaatataagaatgaactaagtatgtttctttagaaaatcaaaccaacaaaaataaatccctaggctacttttgttaaaatgctatctgctaaattgttgctattgtccattttagggtgttggccacagttatgtggtacatagcatttcaatctatagc

SEQ ID NO: 3299 - DNA, 62791 bp, human
aagagcagtaacacaaacagggctgaaacacgccctcctcccgtccccacacccccgcgacttgccatgttgcgggtgatgtgaaggagagaagtgctgtggcccttcagggagcacagacctaggggctccctgagccagggctgtgacaccctctttggggctctgcggtttctggtatcttcaaacttccgggcaccactgcattccccttgtccagacacaggtgcccacagcagaagccgcttgtggttcatcagatccagctgcagacttgcatagaaccggcacctttgccggcgcctggagctgcctgcccagctgcagcagctggtgtgtccggctctgcgcagtggccagaccctgcgttcgctcgcctgcacacccctcgctgttccgtgcctggctcaccctcggcaggcgtggaatcctggctggtagcatgagctgagcacagcctgccaggccacgtcagtggaacaagtctggcgggcctgatcaaaactcaggcaaaggcaccactggtcacagagctttctagctggaaaagcaacacctgaaggatcccgtgacacaatcaacctgctaggagatccctgccaccctgagaggctgcaggaagctgcctccatccaggcctcttcacagaaggagaattgcagagaccgtaggatttttctactcacaggaacagatggtgtccggtcaggaaggtaaaatgcttcaagaaaagtgcaatagggattataatactgatgatctgagactctgataatgactctgagatgattcccaattctatgatgaatcatctcagaatgactccgagatgatgattcctgattctacgatgattgaggcagagctcactggttggtgaatctagttggtagagctgaggcaccgcaataccatcatttctttctgaggtgagagctgtcccaatgctttgaaaatggtctactggctgctctacctgtggagtagccattctttattcctttactttcctaatagacttgctttcacggctgggtgtggtgactcatgcctgtaatcccaacacttcgggaggtggaggtgggcagatcacttgaggtcaggagttcaagaccagcctggtcaacatggtgaaatgccatctctactaaaaatacaaaaattcgccgggtgtggtggcacatgcctgtaatcccagctactcaggaggctgaggcaggagaatggcttgaacccgggaggtgaaggttgcagtgaaccgagattgtgccactgtaccccagcctgggtgacagagtgagactctgtctaaaaaacaaaataaaacaaaaacaaaaacaaacaaactaaacttgccttcattttaaaaaaatggtccacatctcttcatttatgttcttgcctcatagatagaatacacacttatcctcagacagggattatggattttcccatccatgcaagtgacttagagaatgccagccttttgccatggtgccaaagggtagttgactcagtgagtccttttaggaaagtggagctaagtgtacttgtgtggtggaaaaagcagggtttttttgtttttttggccaggcacatttagatgcaaatgtccgtgctgcccagttaccagctgtgtgagtttagacaaggtacttgaatttgagtgtgattatgtgtaaaatgaagtgaataataatagcttcctcctcctagggttgtaaatactaaatgatgttgtaaagccctttgtagagtgcctagaatataacaggcaccctctaaatgtttgttcctttctggctacctggcgatataaggatcccaactatttttgggttaggaagaacagctgcgaatggcctaatggtgccctaaagttgttttatcctgcccttacacaggaccattctcttattcattgacctttggcatgaagcattgaccttcctcacgaataataaatgtgtaatgattcttgtttgccaaccaatgaggtatggctcaatagtcatagaatcaggaatcattagagtatggataatcagtattgtaaaccccactgcactttgcttggagcattttatctgcctggccagacaccttgtgaacagggttcaatccagaacacatcatctgggtaaattatttacaagtctgtctcactttagaagtggaccttattcaggacctaaatagcattcaactataatctacacttggagatttttttttaaagaagcaaacttacagaaaagatgaaagtaggagaaaattttcaaaaggccatgattcagaatatatcaattcacacaacttttcttccttgttcttttttttttttttttttgagacagagtcttgctctgtcacccaggctggagcacagtggcacgatcttgtgtcactataaactccacctcccgggttcaagcaattctcctgcctcagcctcccaggtagctgggattacaggtgtgcaccaccacgcctgcctaatttttgtatttttagtagagacagggttttaccatgttggccaggctggtctcgaactcctgacctcaagtgatccgcctgccttggcctcccaaagtgctgagattacaggcgtgagccactgtacctggccctttgttctttttatagatattttacagataccggataggaggagattatgcagttataatacttagaatctggacaggacagcagacataaccatttcccagactttctattttttttccttttttaaaaaaaatgtcagaaacctatttgttgctaaattttcccaaactttctttcagtacctagtctctgaagccatggttaaaaacaaaaatagggctgggcgcggtggctcatgcctgtaatcccagcactttgggaggccgaggcggtcggatcatgaggtcaggagatcgagaccatcctggctaacacgttgaaaccccgtctctactaaaaaatacaaaaaaaattagcccggtgtggtggcgggcacctgcagtcctagctactcaggaggctgagacaggagaatggcatgaaccctggaggtggagcttgcaatgagccaagatcatgccactgcactccagcctgggcaacagagcaagattccatctcaaaaaaaaaccaaaaaccaaaaaacaaaaaacaaatttaaggacctgtgaatagtagttaagcactctttatttaccttctgtaatatatattagtgcaacacaattctcaattttgtaattcttattctacatttggaatgtgccaaatttattgaagactataaattaacacatttaagaattccagtgaatcccaagctgcataaacacaaaggaaactacaaggcatttcagaatcaaatttctgaaaaccagtgattctttttctttttctttttcttttttttgagatggagtcttgctttgtcacccaggctggagtgcagtggtgcaatcttggctcactgcaacctctgcctcccaggctcaagcgattctcctgcctcggcctcctgaggagctgggactacaggcatgtgccaccatcaccggctaatttttgtatttttagtggagacagggtttcaccatgttggccaggctggtcttggactcctgacctcaagtgatccacccaccctagcctcccaaagtgttgggattacgggcgtgagccatcacacctggcctgattgagagaaaattttaaagatgagactgatgactggtttctcattaaaaacaatgcaaaccagagatggtggaatgacatctttaatgagctaaaagaaaaaaactgccagcctagaattttatatccagtgaaaatgttctccaaaaatgaaggcataacccaaaaatggatttatatttcaggaaatctaaagatgaaagaattcatcactaaaactgtactacgagaaatgctaaaggaagttgttcaaactgatggaaaattataccagatggacacttgaatttgcccaaaggaatgaagagcaccagaaatggcaaatgtgtgggtaaatagaaaatatatttttcttgtttttaacatctataaaagatatttaactatctagggtgaaagtaatggacatgtattatgggctttataacttttgtagaagtggccgggcacagtggctcacacctgtaatcctagcactttgggaggctgaggcgagtggatcacttgaggtcaggagttcaaaattagcctggccaacatggtgaaacctcgtctatactaaaaatacaaaaaattagtggggcagccgggcgtggtggctcatgcctgtaatcccaggactttgggaggctgaggcaggtggatcacctgaggtcaggagtttgagaccagcctggccaacatggtgaaaccccgtctctactaaaaatacaaaaattttagccaggcatggtggtgtatgcctgtaatcctagctactcaagaggctgaggcaagagaatcacttgaacccgggaagcggaggttgcagagagccgagattgcgccattgtactccagcctgggcaacagagtgaaactcagtctcaaaaaaaaaaaaaaaaaaaaaaaaaaaaaaaaaaaaaaaaaagaagggaatggcttagggtaggcaactaaaggttttattaggttcagtcctggacacacagaaaaagaagaacctcaaaggccaaaattagcaaattggcaccactcaagctggtactgcagtgggcacaagaataccctgatgcaagaactttagtggctgaatcttgagacagggatctgtatatatatatatatttatatttatttatttattttgagacagagtctcactctttcaccaggctggagtgcagtggcgcgatcttggctcactgcaacctctgactccctggttcaagcaattctcctgcctcagcctcccaagtagctgggattatagatggggtttcaccatgttggccaggatggtctccatcttttgccctcatgatccgcccacctcggcctctcaaagtgctgggattacaggtgtgagccaatgcgcccggtcaggtatctgtatattgtggagatagatacatcagtctgtctttattcattcatttgtttaacagattttttttactgtgtcaggtactattaaaatctctggaattataacagtagaaaaatcagacaaatctttaccatcatggtgtttacattcttgtgaatgtatcttagctgaatgcaactgatttcatgttcatcaataaatcttctagttataattgggcttctcatgaccctcaagcagacccacatctcattataaattaaaaaattgaggccaggccgggtgtggtggctcatgtctgtaatcccagcactttgggaggccgaggcgggtggatcatttgaggtcagaagttcgagaccagcctggtcaacatggtgaaaccccgtctctactaaaaatacaaaaactagccgggtagtggtgatatgtgcctgtaatcccagctacttgggaggctgaggcaggagaatctcttgagcctaggaagtggaggttgtggtgagccaagattgcaccactgcactccagtctgggcgagagagtgagaccctgtctcaaaaaaaaaaaaaaaaaaaaaaaggctgggtgtggtggctcacgcctgtaatgccagcacttagggaggctgaggcgggtggatcacaaggataggagtttgagaccagcctgaccaacatggtgaaaccccgtctctactaaaaaatataaaaattagccgagcatggtggtgtgcacctataatcccagctactccggaagctgaggcaggagaatcacttgaacccaggaggtggaggttgcagtgagctgagattgcgccattgcactccagcctgggtgacagagtgagactccgtctcaaaaaaaaaaaaaaatgaggccagatgtggtggctcaggcctgtaatcccaggaggctgaggtgtgaggatcacttgagcacaggagttcgagaccagcctggaccacatagggagacctcgcctctacaaaaaaaaaattaaaaagttagctgggcatggtggtgtgcacctgtggtcccagctacttgggaggctaaagtgggaggattgcttgagcttgggaggttgaggctgcagtgagccatgactgcaccactgtacttgagcctgggtgaccaagtgagagaccctgtctcaaaaaaaaaaattgatattctaatttcatgtatcagtctcttggcaaatgtgagtcctcctacacacacagatttacctttagtgaagtgacaaatcaagtttcagactagcatatcggagggccagtatctgaaccatggtaaactcaacaaggcatttcaatcctgtgagccactgtgggagacaaagagccacacagctttttccagttaatgacaccaactgctcagggtagcctttcccttatttagagtgtttacacgtattcatatatgtgaaagggatacaagatgcaaatattaaattacaagcatttgaaatctatccaaggaaggagtactgaccttgaaactgatttggcaatgcattatgaattaattggattaaaaatcattccttggagcattcaaagttaaaaaaaattcctgttgacggacatttagatttgttttctctttctttctcctccctccctccctccctctttctttctctctctctttctttctctctttctttctttctttctttctttctttctttttttctttctactttctttctttccttccctctttctttcttctttctttcttgatggagtctcgctctgttgcccaggctggaatgcagtggcatgatctcagctcactgcaacctccacctcccgggttcaagtgattctcctgcctcagcctcccaagtagctgggattacaggcgtctgccaccaggcccggctaaatttttgtatttttagtagagatggggtttcaccatgttgctcaggctggtttcgaactcctgagctcaggcaatctgcctgcctcggcctcccaaagggctgggattccaggcgtgagccactgcgcctggccttgtttttcttttctttggccatttcaaacaatgttgtttgaaacaacattcttgtgtatgtccttgtgtatgggggcaagaatttatagggtatttacctaagactggagtgctgggtcacagggtatacacgtattcaactttgtgaaatggtgctaacttgctctccaaagtgatcataccaatttacaacctgtactagcagtgaatgagaattcttggtgctctttgttatcaccaacagttgatattttcagaccttttggttttgcttatctgatgggtatgaaatggcatcttatcatggtttaaatttgattaatgtgatagtgatcttttcatatgtttattggccatatatttttcttcttctgtaaaatgctaacttataacttttgtcctttttttctttgagacagtcttcctctgttgcccaggctggagtgtagtggcgtgatctcagctccctgcgacctctgcctcccgggttcaagtgattctcctgcctcagcctccccagtagctgggattacaggcacccgccaccacgcctggctaatttttttgtatttttagtagagatggggtttcaccaagttgaccaggctcgtcttgaactcctgagctcaggtgatctgcctgctttggcctcccaaagtgctgggattacagatgtgagccaccatgctgggctgacttttgtccatttttgattgacttgtttttctttttcttatgcatttgtagtagcccttttatataattcattattctaatccctccccttttgctatttttgttacagacatgtactgaatctgtggctaggatacttttttgtcaatagtgtctttggtcacatggaagtctttcaatttaaagtagtcaagtttggccaggtgcagtggctcatgcctgtaatcgcagcacttggaaggccgaggtgggaggatcccttgagtccaggagtttgagaccagcctgggcaacatggcagatcctatctctactaaaaattaaaaaaattagttgggcacggtggtgcacacatgtggtcccagctactcagcaggctgaggtgggaggattccttgagtccagtaagttgaggatgcagtgagctgtgatagtgccactgcactccaacctgggcaatagagtgagaccctgtctcaaaaaaaaaaagtcaaatttatcaatgcatttttaactgagactatgttattgggtacaagcaagttcaaagtttttatactaatattttcatggtgaatttttccttttatcatgtttgtgcctctttatctttagagtggttttttatattatttattttttatttattttgttctattttatttatgtatttttttttttgagatggagttttgctctttttgccctggctggagtgcaatggcacgatctcagctcactgcaacctccacctccctggttcaagcgattctcctgcctcagcctctcaagtagctgagattacaggcacatgccaccatgcctggcttattttgtatttttagtagagatggggtttcaccatgttggccaggctggtcttgaactcctgacctcaggtgatctcatcttggcctcctaaagtgctgggattacaggcgtgagccaccgcgcccagccagttttatatttttaaattttatatgttattgtttatttatttatttatttttttgagaaagggtcttgctctgtcacccaggctggagtgcagtggtgtgatcacagctcactgcagccttgatctcctgggcacaagtgatcctctgccttagcctcccgagtagctgggactacaggcgcataccatcaccctggctaattaatacagctttatttatttatttatttatttatttatttatttattgaggtggagtctcacactgttgcccagactggagtgtagtgctgccatctccgctcactgcaacctccgcctcccgggttccagcgattctcctgcctcagcctcttgagtagctgggattacaggcgcccgccactacgcccgactaagtttttgtatttttagtagagatggggtttcactatgttggccaggctggtcttgaattcctgacctcgtgatcttcctgcctcggcctcccaaagtgctgggattacaggagtgagccaccgtgcccagccaatacagctttatttttgtaagtatttacctgataagcgtttttcctaatctttactttcagtcttactgtatcttcatgtcagtgtcatatcaaggacaagacagcagaaatggtccactccagttgcagatagtaaagaccctgtagctccagcatcagctcacctttctggttttgaatttcatgcttattaccatcctgtcatcacctactgtttccatggtagacgggactaagagatgggtaagaatgatacatgtgtaaggatgtaaccaataaatgacacagactcacatccacctgaaagggcacaatgaaatagtagtaagaagtccagaatctatttttgccaaagtacagtggaaagaagtggaaatacagtttccttatttattggctttaggtggaaaagagtcctagattacaaaaattaaatgcagacataggcttctgagatgacaattttcaagtcattttatttgcaatatggtggggagcccgtcaattaagttagaactatctgtcattcattactttataatttaccagagtaaaaataaattagaatacatttgtccccatggggagacaaaccaaaagggagaaatcttgtctgaaggcttggaaaatgctgaatatgtacatgaaaggggaacttgaatactacaatttgaggccctgtgatcatctaggtttctagatgatgtctcatttccaagtttgagtcctgtgactgcagagtcccctgattccaccagtgactgctgttatcaatgactggggtcatgaacctactttcagatctaccccattatcgggttttcgtgacaagtctcgggtgcaggactgcgccctctggtggagaaggacacaactaattacacatctgataatagccagtacttccttttttttttttttttgccattactttcagtggcaaaaactgcaattacttttgcaccaacctaatgtttggtaaatgtgtgctagccatcaattgctggccatttgactttttggagagttacttaatgtctctaaaccacaatttccttatctataagatggtaatactgacctcatacagttgttgtgagtattaaataagattagtgcttatttaaggaattagtgctcaataaaccatactatccatactattatttggtcactttttttttttggacggaatcttgctctgtcacctaggctggagtgcagtggcacaatctcggctcactgcaacctctacctctcaggttcaagcaattctcatgcctcagcctcccaaatagctgggactacaggcgtgtgccaccacacttagctaagttttgtatttttagtagagatggggtttcatcctgttggccaggctggtctcgaactcctgacctcaagtgatctgcccacctcggccccccaaagtgctgggattacaggcataagatactgtgcctggcccaatcctgtaatttttaccctggcagatttttactaattatgttaaacaacaatacagaaattcaataggaaccccttttaaaaataccaactagtgcctgggcgcgcatggtggctgatacctgtaatcccagcactttgggagtttgaggcgtgtggatcacttgaggtcaggagttcgagaccagcctgaccaatatggtaaaaccccatctctactaaaaatacaaaaattagctgggcttggtggcaggcgcctgcaattcccagctacttgggaggccgaagcaggagaatcgcttgaactcaggagccggaggttgcagtgagccgagattgtgccattccactccagcctgggcaacaagagcgcaactccgtctcaaaacaacaacaacaacaacaacaacaaaacaaaccgactagtgagggttgcttctggtgatattcttttatgactttgctgaacccaaatgtaaccagccctattacctttcacttgaaaaattcattacttttaaccaaaaggccttgggactaacccactcatcagcaatggaggattccaacattggtgccttcaactgtcagtatttttcttgtattctgacttcttcttgcctagtggttcacgagttagatatctaagtcctggaacaggacagaaaggtacatcaggggctggcactctggtgggaggtgatatatggacctatggtccctgctctgatgaaatccaacaatttctttgtgtgtgggaggggtaagggaaatcagataaatctgtcttctagctgaataggagggctatcactcaaaatgaactctgacctcttcgttagtccaagctcttggctcttgatctcactggtcaatccaaccatgaatcagggccaagattaagaataggcaagtgagacactcacctgtgcagaatttaaaggggtgaaaaccccaataatcaagataaataatatttcaatggaatattagaaaaatcaaatttgcattcaaggcaaatgcctcacttgccacaccctggtcctgaccctggccctgcttgatataactgcttctataattagtcacaagtgaagggaagtaagtagtgaggtcagttataggctgggcatcagacatcagtaacaatcagggattgatcaatcctcaatctcccaagtgccatgggaggcaaggagttgagatgaccgtggaatagaggattggggtgggagggtatggaataatatgcacctgttctgcacatctgctaacatttacccaatgtctggactgagaagcggagttattttttctcattacaatgttggggtggacatcctcccccaggcacgtggaatggcatatggcagcatcctgcattcgtgtttgcagaatacatgtctgaaacagccttggaggactactactctggtttagggctgcaaaccacactgtgtcattgaatgaacaagcaacatttaacctgaactcaagaaaatggaaggaaaggagtaaaatggcaaatagttaaacttgaaggcttgcacaagaaagtgggactaggccgggcatggtggctcacacctgtaatcccagcactttgggaggccgaggcgggtggatcacgaggtcaggagatggagaccatcttggctagcacagtgaaaccccatctctactgagaaatacaaaaaattagctgggcatggtggcatgcacttgtagtcccagctactcgggaggctgaggcaggagaatcgcttgaacccaggaggcggaggttgcagtgagccgagatcgcaccactgcactccagcctgggcaacagagcaagactccatttaaaagaaagaaagaaagaaagaaagaaagtgggactagacttagacttattctgtgtcatatcaggggcagttccaggaagcagatattagctccatgtgaagaaaaatgtttaataacaagaatacccctagagaactgccctaaagaatggggagcttctggaaaaagggttacaaaagggcatttctactttatggggcaggtttgctgaacctgttcttttttttttttttttttttgacacagtctcgctctgttgcccaggctggagtgcagtggtgtgatcacagatcactgcagcctcaaccttctgggctcaagtgatcctcccacctcagcctttcaagtagttgggaccccaggtatgcgccaccacacccagctattttattttattttgtatagacagggtctcactatattacccaggctggtctcaaactcctaggctccagtgatcatcccactttggcctcccaaagtgctgggattataggcatgagccaccacgcccagcctgaacctgttcttatagggttgttgccaattcctatattctattcttttttctagattggctgccaggaaacatttgactcttattatattactataagcatcttaggtcacttccataaaaatagcactcagagtcagtggggagaccagtgtggaattttctgattcatctctgcctcaaatcataaaaaaacttgcttaactgattattgtaaaaagtttgattcctttttctttctttttgtactgtatctttcttttctaaaagttgcagcttgatttaccaattggaaaatatgtcctcttttctcataacatgtgcttagccatgcaaattgctgttgtgtacactcatagtccttgagagatgatgtagggggttgaaaaatgtcttggctggcttttaggagccttggattatagttctgctcttccgctatggccttaggcaagtcttttaagttcactaagtcatattttccttgttaaaaacattgtttggcttttgagatgcaggctggaatgctatcacagttcactgcagcttggacctcctgggctcaagtgatcctcctatctcagcctctgaagtagctgggaccacaggcgtgcaccaccatgcctggctaatttttgtattttttgtagagacgaggtctcattatgtggcccaggctggtctcgaactcctgggctcaagtgatcctcccgccttggccttccacattattgggattataggtatgagccaccatgcccagcctcattgttaaaaaagttgtaaaaaaattgataaaaacatttgtatatgaggagaggagagaaggaataggatagttttccaggtctcttagagctctgaaatgtaaagtttgtatcatctctgagctgagtctagcgaagttgtttcatgtcttgatcccatttctttcctcacctccacccccaatcaaatgataatagaaggtgcggggtcagataatcaggtaatgttacatgacatttcagaaaaccactttttttttttttttctgagaaggagtctcactctgtcgcccaggctggagtgcagtggcacaatctaggctcactgcaacctctgcctcctggattcaagcagttttcatgcctcagcctcccgagtagctgggattaccagcgtgcaccaccatgcctggctaattttttgttgttgttgtatttttggtagagatggggtttcgccatgttggtcaggctggtcttgacctcctggcctcaggtgatccacccacctcagcctctcaaagttctggaattataagcatcagctactgcgcctgcctgagaaaaccacattttaaaaatggacttgatggtagtctgagctactaggcgcaactgtttatggagcaatatttttttatttcttatttttttgagactgagttttgctcttgttgcccaggctggagtgcaatggtgcgatcttggctcactgcaacctccgcctcctgggtttaagtgattcacctgcctcagcctctctagtagctgggattacaggcatgtgacaccacacccggctaatttggtatttttagtagagatggggtttctccatgttggtcaggctggtcttgaactcccgacctcaggtaatccactcgccttggcctcccaaagtgttgggattacaggcatgagccactgtgcctggccagcaatattgtttttaactgggtttttaatccagtagacatttacattaattgctaacttgctgtcctttttctgaactggcagtctgcatgttgacttggtgattggcccccaagcacagagcttcagtgtatctggttgagcagtaatgcctgctgtgtttgcaattagatgttagggacactcacagctccagggacttgcaccagtgctttccccaggttctcaggcctcatgggctcaacagcatggactcccacttactgagcttcacctggctactgccacctttgaatgtccaacctgccatcagagaccaatgccaagtcccctgacatggcactcttcttcaaggagactcacaagctacttggcaagttgatgacattggacccctattactttagaagggtcagcgattttttaaaaaatatttatttatttatttatttattgagatggaatctcctctaccacccagactggagtacagcggcccgatcttgcttcactgcaacctccacctcctgggttcaagcaattctcctggcttagcctcctgagtagctgggattacaggcacacgctaccacgcccagctaatttttgtatttttatagagatggggtttcaccatgttggccaaactggtcttgaactcctggcctcaactgatccgcctgccttggcctcccaaattgctgggattacagacgtgagccaccgcaccagaggagggccagagatttgctctcacaggaatcagtattttctctgagtatgactgcctttcctacctgtagggcttcatttaccatcattatcctggggcttttggaatgcctgatccacaggcctggattctcacacaagatggcatctgaggagacctgcttcatcatgaaggaggtgtgggagcaggtcctgaccagtaggattcatcgttcatatcatataccacagcattcacaagtagccatcctaacagagcatctgaatgatctgctgaaggtgtaattgaagtgccaacttggagacaagactctgcaagcatggggtaccatcttccaggatgaaatataggcactgtattcatgttctattgctaggtaacaaattaacacaaatttagtggcataaacaacacatgtttattaccttacagtttctgtgggtcaagagtctgggcatagcttagccgagtcctctgttcagggtctccaaggctggaatcgatgtgtcagctggggctggggtctctcttctaagttcacttggttgttggcagaattcattttcttgcagttgtataacttcttttttcttcaaggccagcaagagaattcttttttttttttttttttttttttgagacagagtctcactctgtcgcccagtctggagtgcagtggtatgatttcggctcactgcaacctctgcctcccgagttcaagtgattctcatgcctcagcttcccgagtggctgggactacaggcgggtgccaccatgcctggctaatttttgtatttttagtagagacggggtttcgccactttggcctggctactcttgaactcctggcctcaagtgatccgcctgcctcagcctcccaaagtgctgcgattacaggcttgagccaccgcacccggcctccaattactatcatttctaatggcccacaggggcactcatgtttcctgaatttgcaactgtgggctctgcagagttcaaggttctgttctgcaaaggggcacattcttgccagtggacacaagtgtgggtatggccaggcctttggacttcttgtggccaaggagtcagcaccttggcagggatacttgctctcaatcagcaggaagaggctgctgttgtacaacgtggcagagaggaatgtgtgtgaaacttgggtgatcaatctagttgggcacttcttggtattcccttgcctggttgtgactgcgaatggacaagtgcagcaactctggtgtgaaatggatatgattaccaggggctcagatctcacaggaatgagggtttgggttacaccattgggaaagctagaggtgaggggaatttagaatacatggtagaggaaagacaggatgagaaccagctgtgactccaataccaactgtagtgacagggactgtagttagtcctactaacctacctcttctaagtttcccttcaggaagagagacccatgggaaccatggaggagttccctgaatgtgtatggggaaatcgatctgtgcagtgcagggggtgacccgtggtagccatggaggtgtcccactcagatctccctacagcagacctgccacaaggggtggagttagcggacagctgtcaagatctgcctcagctttcaagctgaggctacatgcttcccagacagcctctaagcaaaggccaggcactgccatggtacaagggctcaccatttctggccagtatgggactcttcgggagggcaatctttgcaccagcactccctgttttgcaggcctaggctttctcagagctgcactgcagtccaaggctcctcctacccaaatatctttcctggcccctctcctttctcaggttttagtcctacatcacgaactaaaggtgttccttgtctggtcctgttccctctcccttttatgttttataggcgttgcccctaataaaccttttgtatatctgactctgtacccctatattattgaaagagacagatttattgaaggtgataccctgaaatgaagatgtcctgttcttacagatgccctctgatcctatgttaataatagtattatatgttttaaatgtttgccttcttctttctttcttttttttggagatggagttttgcttcatcccccaggttggagtgcagtggtgcgatctcagcttactgcaacctctgcctcccagattcaaccaattctcctgcctcagccgcccgagcaggtgggactacaggcatgagccaccacacccggctaatttttgtatttttagcagacacggggtttcaccacgttgaccaggctggtcttgaactccggacctcaggtgatctgccctccttggcctcccaaagtgctggaatgacaggcgtgagccaccgtgcctggccatgtttgccatttttaagcaagagaaaattgttagagggaaaagcatttcttttgtttgtttgttttttgagactgagttttgctctggttgcctgggctggagtgcaaatggcgtggtctcggctcactgcaaactctgccacccgggttcaagcaattctcctgcctcagcctcctgagtagctgggattacagttgtgcaccaccgtgcccggctaatttttggatttttggtagagacagggtttcaccatgttggtcaggctggtcttgaactcctgacctcaagtgatccacctgctgcagcctcccaaagtgttaggattaaaggtgtgagccaccgtgcccggcctggaaaagcatttctaaagacacgaacctttctctcgctctctctttttttttttttttttgagatgaagtctctgttgcccaggctggagtgcaatggcgcgatctcacctcactgcaacctctgcctccttgggttcaagtgattctcccgcctcagcctcgtggacgagaacctttcaacacttggatttgaagagcagtcataaaagtggagctgggggccacaaaattacaaaaattagccaggcatggtggcaggcacctgtagtccccgctactcaggaggctgaggcagtagaatagcttgaactcaggaggtggaggttgcagtgagccgagattgggccactgcactccagcctgggcaacaagagcgagactctgtctcaaaaaaaaaacaaaaaacaaaaacaaacaaaaaactaagcacattcacgtaacagcccactagtctttctgtttttttctttaacgttagggtgaaaaatacttttttttattattttttttttgggacggagtctcactctgtcacccaggctggagtgcagtgacacgatctcggctcgctgcaatctccgcttcctgggttcgagcgattctcctgcctcagcctcctgagcagctggtactgcatgtgtgcgccaccacggccagctaattttgaattttttatagagacagggtttcaccatattggccaggctggtctcgaactcctgacctcgtgatccatccgcctcggcctcccaaagtgctgggattacaggcgtaagccactgtgcccagctggaaaatacttttacattgtttccttctcccttcctgactttattattactattattatttatattctgagatggagtctccctctgtcgctcaggctttgagtgcagtggcaccatctcggctcactgcaacctccgcctcccaggttcaagcaattctcctgactcagcctcccaagtagcagggagtacagacgcgcgacagcatgccctgctcattttttttacctttagtagagatgggggttttgccatgttggccaggctggtcttgaactcctgacctcaggtgatctgcctgcctcgagcttcaaagtgccaggattacaggcgtgagccaccgtgcctggccctcccctcctaactttattgtggatccttttgtataatctgaataattgaggaaataagatatatttttaaaaagtttctgtgtcctaatgaaatcgtagttcgaatcactttgtttgaaagttgatgacagttttccaggaacattttctacctaaatcagatatccaaaagtatatattattcagcagcccaaggaaagatggtaactggatatttttcactcataatactagattgaactaacaatgcctttggccgggcgcggtggctcacgcctgtaatcccagcactttggaaggccaaggtgggaggatcacgaggtcaggagttcaagaccagcctggctaacatggtgaaaccccatatctactaaaaatacaaaaattagccgggtgtggtggcacgtgcctgtaatcccagctacttgggaggctgaggcaggagaatcgcttgaacccaggaggcggaggttgcagtgagctgagaccgcaccaccgcactccagcctggtaacagagcgagactctgtctcaaaaaaaaaaaaaaaaaaaaaaaaagaagaagacctgacaatgccttgttaggttttgttgtttgatttaaacaatttttttttttttttgtagagatggggtcttgctctgttgaccaggctggtcttgagctcctgttcttaagcaatccacccacctcagcctcccaaagtgctgggatactgctttccagccttgttatttgattttattgttttacttgtaataacgacattaatatcttatgtatctgtcagtgcatgattaagtaacttttaattacacaattgataccatctctgttatcctgagaccatattaaaatagaactaatagaacataacaggaaacaaaaaggttgggtagagaacctgttacttaaggacggtgattctcaccactatacaattgttgtatgtttcctgttttgattttgtgaccatttccccttccttctctgctatccaaaatgtggtatagcatatatgcttgataataatgacgacaacaacaacacacacagaaatcagagttgctaagctgttttaagaattttatgcatgctgccaattgaggtagttagagactcgtggatgaatgctgggcaggctaggtctagcaggggttccctgaagttacaactaaggtaggtgggctaagtgatgtgatcatttttttccctctttaaccttctagtggacatctatgtggttggctgctccatactcctcttcttttctttctttctttttttttttttttttttttgagatggagtctcttgcccaggctggagtgcagtggcgcgatctcagctcagtgcaaccttcgcctcccaggttcaagcgattctcctgcctcagcctcccgagtagctgggattacaggcgcccaccaccacagccagctaatttttgtatctttagtagaggcaggggtctcaccatgttggccagcccagtattgaattcctgacatcagttgatccactcgcctcagcctcccaaagttctgggattacagacgtgagccaccgcacccggcctcggtactccttttctaagaaggtgctccgtatccccatctgtacagttacttacagaaataaccatgttagtagattgtgacccagtacctggccatgagtctgggtgagggggttcctggtaagtcagggcaagggttccttaccctgatgccacagttggctagtccaggagtgtgtacctgatccaaattggaccaatgaatctcttctcagaacttttttgtatttgggccgtagaaatttcagtcagtctgtatgtgtgtggctgtggttgtaagatgtaaagttcaggagcttctattgccatatggagaatgtcattacatagagagaaaaaagaatgaagccagtatgcaaaggaaagcaaagataagcaatagagagaaggcatctgcatggcattaagtccctggtttcagctgttccagccaaaatcgatggtgtttattatattgatgagaatgtgtctttataatttggaaattgacggaaggcgacttgattgcgggaaaaactataaactgtacctacctattataccatttacaaaaaattctctcttgtacttattttttctccctgagcctcctattgcttcaaagaaaagttcaagtaaaaagaagaacaaaaatagcataattcaatacaatatttattgccctctgtgttaggtgtggtagagtataaagaaatatggctgacccaaaaccaacaagacaatcactgaaaagtgacttgtgaacaatgtgaacaatgtgacaaaaatgaaaagacaatgtgaacaaaaatgaaggagagatccttgtaggctaaaaggggagtcttccagatgtgagattgataaaagcagggaaaattcagtagaaagagaaagccgaagaccatgctccatgtgtaactcatgaagtgattcaaaacagaaagctagcttaattcaaatcaatacatttttactaagtatggggtattgcgaaaaagcatatggcccttgccttttaggaaattgccgtatttagaggcaaagcaagacttgcttatattctcaaaagatccccactcgttaccttatttcccctttaaaccgctttaccatatttgagatcatgttatttgctaacttgtttgttgatttgttttccttccttatcaagaggcaagccccttaagggcggggatttttgtccttttttctttttgcaaccccaacctctgcaatagtgcctggcacaatgcaaacagctcaataataattcgttgaaagaaatggagaattagatcgtagggtgaaataatcttaaactctctggccttgaatctctctagctcgcccaagatatcaaacattgggggtcaggccgagaagaggagaggaacaattttttcctgttaggtcagtggtttttagcctttggttacattagcatcacctgggggcatctttagacatcatcccgaagcccagaccgcacccaggactaaactagaatctccagccagtgggtctcaagcatcagttttttgttgttttttttttgagacattgtctccttctgtcgcccaagctgaagtgtagtggtgcgatctcggctcaccgcaacctccgcctcccaggttcaagcgatactcgtgcctgtcccccgagtagctgggattacaggcgtctgccaccacgcctggctaatttttgaatttttagtagagacagggtttcgccatgttggccaggctggtcttgaactcctgacctcaggtgatctgcccgcctaggccttccaaagtgctggaattacaggcgtgagccaccgcgcccggccaagtatcagtattttggaaagttgcccaggagattccaatgtgcagccaaggggaagaacagacggagccaaggcgcggggatcaaggataaaggagacaagctccactaggcagagccgggcctcttctcgacgtcacgccctggcgttgctgcgtggttcgtttactcaaccgagaataggccggtcctcgctgtagcaacacgacccgcacaactgattgagtgggaagctccgcagaggcggactccagcctcccgccaatgaacgggtagggtccgcccggcacagcgcggccacgccccctggacgccgcggtcccgcccccggacaccgctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggtaggtggcggggcgtggaaggggctggcagggcggtagcctggggtgccatcgtcttcccctagagcttcgggctggccccggcggaagaagtgggccacgcatgggcatttgggctctatgataaggggcgctcgcccactgtacctccgaccggacataagcccgccggcctttggttgggagaacctcgcccccactttggcgacttctagcactgagtttgatattaaaagcaaagcagcacttttaagggaggaagttgggtgttccctaaaattcctttggccttgctcatccggggtgtggttggtagccgcgtcggggtagccccttgtcagaaagataatatttggagttctatgttacctctagcccttcatcttcctttggagaacatttttaggattaaatgcttgacctacttcggctcttacttaagtttgttgtaacattggcagagattacagggtaccttttggctcccaggaccctaggactgtgcgtctaggaccctggtgccaatttgaacttaactttaatgagccgcaaagcccttataagaggctgggtgctttgattgggccacgtgggtaagggaggatgcctttttgtatatgtaatcttcccagctggcacagttaaggcctgagggccttagactccagagcgtgtctagctctccctaatccctttcacccgagcatgccaccctttccaagttttctgcctggctgcatcccagggggctcacacctgctccagtttctgaagttatctcgctgccagtgggcctgtccccctgatgtgactcatagtgcttttgactcacattaaccccatcaattctcttgggggtcctggatatctctctctctctctctctccctctctctctctctctctctctcactcactcactgttcctggggactttgttatcagttgtaagggttctgtcttgtttatagtacttaaaaacaaacaaaaaacctttgttaaactatttgaaggcagactgaaagtcattatgagaggggccacagttgactttagcttgcaatgtgaaaggtcttctacaaaagctccatggtcttgttcaggtgctttctcttataaccctgtgttcctttcttgaaaattctattgaggccgggtgtggtggtgcacgactgcagtcccagcgttttgggatgctgaggtggatggatcacttgaggccaggagttcgagaccagcctggccaacatggtgaaaccccgtctctattaaaaatacaaaaattagccgggagtggtggtgcatgtctgtagtcacagctacttttggaggctgaggcaggagaatcgcctgaaccggaaggcagaggttgcagtgagctgagatcgcgcccctgcactccagcctgggcaacacagtgagattctgtctcaaacaaaaaactattgaaccttaagcggataatctcttagtgtctagtgagaggaggagttcacaaatgaatatagactgagatgattaggttctttgactggtgggcaacctttgtagcttcttttcttttttagacttgcaagaggcacctttgtttagtctctaaatagaggttatttcctcagagtggagggcatatgagtggtattgcctgttattgcactgaacactcttccttgccaactgctgtaagcttgggacccagggctgagccagggtgagttatgtgactccccaggtaggccatggaggccttgagttttcttttttttttttctctttgaaatactttttttatttctttgggatatatgtccagaagagaaattgctggatcatatggtagttatatttttaatttttggaggaactgcctcattatttttcaaaatggctgtaccagtttacattttcaccaatagtgtacgagggttcccttttctctacatcctcaccaacacttgttatcttttgtctttttgtaataatcatctttttattattattattattatactttaagtttagggtacatgtgcacaatgtgcaggttagttacatatgtatacatgtgccatgctggtgtgctgcacccattaactcgtcatttagcattaggtatatctcctaatgctgtccctccccactccccccgccttgagtttcttgatctcctttgattggaaaggttcagttacaaggtcctgggatttgagtgttgcaaaggcctctccacagtaaaggcctagaggttttgctataagtaagactcctgagggcttatcaggagataagccagtaaccctgaggtactgaagtgttgagtattgattaaaaccattctcccacctcctccacctcagtgcggtgtgtgtgtgtgtgtgtgtgtgtgtgtgtgtgtgtgtgtgtgtgtatgtattgggggagatcggaagaactgggctctatctggactctgctggtgtgcctgttgactggcactgggggaaagtcgtctgaaactggggcctcagtttcttaaggaggttggtttgaatcagaatcttcaaatatagggggatctgagggtacaaaaagggtctgtgcacctcctgaaatagtatataccattgtgtgtgtgagcaaaaatgtattccaacccttcccacgcccgctcgaggtccacagtttccatcagattatcagtaaataggataccaaatgtagtgaaaagttaccattacatgccaggcgcggtggctcacgcctataatcccagcactttgggatactgaggcgggcagatcacttgaggtcaggagttcaaaaccagcctggtcaacatggtgaagccctgtctgtactaaaaacacaaaaactagctgggcatggtggtgcacagctgtaatcccagctgctcgggaggctgaggctggagaatcgcttgaactcgggaggtggaggttgcagtgagccaagatgttgccactgcactccagcctgggtgacagtgagactgtctcaaaaaaaaaaaaagttaccattacccgaatactcttgaatgctatgttgacagtatgatatagatttattattaccaatatgctattggtataagcaacatttttttaaaaagtgttccaattatgcctttgttgtgccacaggaatgtatttccaaattttttaaggcagcatgcaaagcaatggggctctaggactacaattttccaaataaattggcccaagtgtttctctgtattcattaactcccttcttttctctcctcatttgattctatgtttggcagtggtccgtgatagtgcctggcttaggctatctttcctttttttttggagacagagtcttgctcttttacccaggctggagtgcagtggtgcgatcatggctcactgcagcctcgacctccccggggctcaagtgatcctcccacctcagcctcctgagtagctgtgaccacaagtgtgcaccactacgcctgactaatattttaaaatttttttgtagaaacgggatctccctatgttgcccacactggtctcaagtgatcctcccgcgttggcctctcaaagtgctgggattacaggcgtgagccattgtgcccagcctggttctttttgatctttaggggagactttggagaagcatgactttctggaataatgatagctagagatttttgaggacttgtcagtatattagacatgctcttctagacgtgcccttcagggtttaatatgtgttaattcctttatccttttgacaatcctatgggataggtagtattattatccccattttacagatgaggaaactgaggatcagggaggttaggtaacttgtctaaggtaactcagctaacaagcagcatgattgggctcttttttttttgagacagagtctcgctgtgcagtggcacgatctcggctcaccgcagcttccgcctcctgggttgaagcaatactcctgcctcagactcccgagtagctgggactgcaggtgcccgccagcatgcccagctaattttcatatttttagtagagacggggtttcaccatattggccaggctggtctcaaactcctaacctcaagtgatacgcctgcctcggcctcccaaagtgttggcattacaggcatgagccactgcgcccagcctttgggttaacccctatactgtattgcctctcacacaaacaggatggaatgattttcatccctcttcagaaaatgctgcttcttagtgtaacaaaacaatttctgtgtatatgtgtatttattcaggtatgtgagactggttatatagctcctgttagtgatgcgtattcagggtatttagccattcagaatcagatcccatttcttatgttggatacatttaacgtgtctattatagttcctattaatgtgttgggggtcatgatttttttgctctttcagctaatggtagcaatagaaaggattagctttttccagtgtgttctttaaaaccagatatattcagttgtagaatgctagtttcttttttgagatggagtcttgctctgttgctcaggctggaatgcaatggggccatttcagctcactgcaacctctgcctcctgggttcaagtgattctgcctcagcctccagagtagctgggactacaggtgtgcgccaccatgcctggttaatttttatgtttttaatagagatagggtttcaccatgttggccaggctggtctcggactcctgacctcaggtgatctacccacctcagcctcccaaagtgttaggattacaggcatgagccaccatgcctggctgcttgtttctgagatggaagaatgaaggaatacttactctgtttccttcagtaaggcatatgaacctatagaagatacataaaacaaaataatgaaaaaaatggaaaattcaaatcacgttctgagaaaatgcagattagatggtcaaaaacaaaaagacggccaggtgcggtggctcatgcctgtaatcccagcactttgggaggccaaggtgggcagatcacagggtcaggagtttgagaccatcctggctaacatgatgaaaccccgtctctactaaaaatacaaaaaattagccgggcgcggtggcggcgcctgtagtcccagctactcgggaggttgaggcaggagaatggcgtgaacccgggaggcagagcttgcagtgagccgagatcgcaccactgcactccagcctgggcgacagagcgagactctgtctaaaaaaaaaaaaaaagacaaatattaatctgtatacgaaagtacaggaattgaatatttatcgtgaaaaagtgaagctaaaatatttaagagagaggcttgttagctgtgtgattgaagaataaacagatccaaaaccccaaaccctccagcaagaattttggtcttagtggaccagcagggattgtattgcaaccaaataagatgactggtgactaagaagttcaattagccaatgagtatgtgctcatatttctgtgttctgtgcaattagatgatttgacttggtgaaaggataaggatttgttctaacagcacagtgtcaaaactgcatgtagattttacagaatactgtaaatactgagaggctttctctgaatgctgtcattcagaagagaaacctatagtagcttggtctgtaaagaaaactaaaaatatctcttttttttgttgttagtcattgcttattcccacattaggtggtgagaatttactagtaaattgaactggaatgagtgacagtatctggggttctgggttttttttgtttgtttgttttatttttgtttttgttttgagacagagtcttgctctgttgcccaggctggagtatagtggtgtgttctcggctcactgcaacctccatctcctgggttcaagcgattctcctgcctcagcctcacaagtagctgggattacaggtgcctgccaccacacccggctaatttttggatttttagtacagacagtgtttcaccatgttggccaggctggtctcgaactcctgacctcaagtgatccacctgccttggcttctcaaagtgctgggattacaggcatgagccaccacgcctggcctgcggggttcttaacctattcagtgccttgccttcttcaactgtgctctcacagatcagtttattaatctgtgatattgcctgtgtgctacccctgacataatattgtgtgattaggagtcaatgcttaagcaataatgaaccaaaatcaacttattttgggagagtaggttaggcacatttaggtagacagcttttattttttatttttttgaagcagggtctcactctgttgcctaggctggagtgcagtggtacaatcttggctcactgcagcctcgacctcctgggttcaagtgatcctcccatctgagcctcttgagtagctgggaccacaggtgcatgccaccacgcccggctaatttttgtattttttgtagagatggggttttgccatgttgcccaggctggtcttgaactcctgggctcaacctgtctacctgcctcagcctcccaaagtgctgggattacaggcctgtgccaccgtggccagtagatagcttttattttattgtgttgggactctagaaaatttctgcgtaagttaaataaatactttctttgcatctggaaagggctaattcaattttcaaagtttactttataattgggtttatcttatttattgaggaaatatggtgcgataataaagaacagaataaattgttcataatgagtttgctcagttgtttactaaatcgattatggacttctgaaactaataaaatagaaagaccaataataaatgcattaaacctagttgccgtcttttatttattttgtagataattacctaattggtctctgctctcaagaaatgtttactctagtgggagagatgatttatggaatagcctcatgaaaacatacatatacttgtgaaacagctacagactcctacaagacaatatatactaagggtgatatggccagatactctgggaggagggtaggtctttagggttgccagggaagaagctgtgggatctgctctgtgttttatcttgttttataggctttgtgccttgggcaaagggcagcttactcctggaagaggactgactcaaggaccccagaaccccaagaaacagggaatcttccacattcatgaaggcaagcatggtgtctctgtttgatgcctatgtggtgaaaaaccttgttttacttttatttgaaaggtatatagagtgatagtttagagcaaatgaggcatattaaaggtagatctttcataaacatttcattgacaaaatgaccaggatagctgcataatattaatagcttcagatagaagtcacattcagattttgaactattgttcctgggagccttgaggactgagctcttttagttaggtgatttccacttcctgtgtgtaggttctgaaggcatggaaaaaaagagatgggcccattagttgtatcaagtaaacactcctagtccatagttatgttcgagggatcctgttagtccatgcttaattaaagttaatttcaattaccaatatgatacgtaaactatggattgtctttattaaactaggagtattcgttataattaaaattgcggcttctttaaagggtccaaataaatttatattatgtgtgtatataaatatatatgtaagtaaaattaaaaagtttttccttcttggccctcaatacttgcctctcttcttacactgattaagctagtagtaattattttatgtcagtgagcatcagtagtccatgtactatttgaggtactttctgtccattcttttttttttttttttttttttttttttttgggatggagtcttgctctgtcacccaggctggagtgcagtggcaggatctcggctcactgcaacctctgcctccctagtagctaggattacaggcatgctccaccacgcccaactaatttttgtatttttaggagagatggagtttcgccacgttggccaggctggtcttgaactcctggcctcaagtaatctgcctgtcttggcctcccaaagtgctgggattacaggtgtgagccttttttttttttttttttttttgagatgaagtctcactctgtcgcataggctggagtgcagtggtgggatcttggctcactgcaacctccgcctcccaggttcaagtgattctctgcctcagcctcctgagtagctgggattacaggtgcccaccatgccaggctaatctttgtatttttagtagagacggggtttcaccatcttggccaggctggtcttgaactcctgacctcatgattcacccacctcggccccatccattcttttattcaaggaacttaggaggaaaaaatcagaaataagactaagttactaatggttgttgtttgcagttctctaacatttagttgtaattatacatcaaatttatggtgtatccaaaattgtttgatagaaaaatcaaccatttttcatgaaagttaaaatgcatgttcatataaattatatttggttttgatcagttagttattgaaggactgaggattgctatagttaatttcctataactggaatgtatattttgaagtgctaggaaaaacacataaactcaacacagtatttgaaatactacagatttatcttttagttttgaattattgctggttctctaattgattttccctttattcatatagcatgttcatctatacatgtgaatcatggtgtgtgtggtaattagtatcagcttttcttttaagagcttaaattttgtaagcactaatatacgcttgcacttttgggcagtggcattaactaaaattgcattctttgccttagcttgatgtaagtctttgcttcatttttctggcttaaacttttctaacaaccaggagactataaatatatgagaaattaattataatgagactcagatttggatattagtattagtctctgaactaagtaatttgatctattactgcgtataagaagataggtgggggccaggcgcagtggctcacacctgtaatcccagcactttgggaggccgaggcaggcggatcacctgaggtcaggagttcaagaccagcctgaccaacatagtgaaaccccatctctactaaaaatacaaaattagcagggcatggtgatgcctgcctgcaatcccagctactcgggaggctgaggcaggagaatcacttgaacccgggaggcggaggttgcagtgagctgagatcgtgctattgcactccaggctgggcaacaagagcgaaactctgtctcaaacaaaacaaaacaaaacaaaactacaaaaattagccgggtgtggtggcacagcgcctgtaatcccagctacttgggagactgaggcaggagaatcgcctgaacccgggaggtggaggatgcagtgagccgagattgtgccaccgaactctagcctgggtgacagagtgagaccatctcaaaaaaaacaacaaaaaagaagataggtgggaatcctgttcatatctccatcataatggctcttactggctaacactgatacagccccattaagtgaataattgaagttatccttttttgtttgtttatataaaccctagtgattggcacaaaggtattcatttgtgcacctttaaagagacagtatagttctttcaggtttttagggagcagaggcttgatcctgtccctgagctgtttgttgtggcattaaatggaaatctatggatctttaaatcttttgagtgcatgaattgctttttgtagttcttgagctcattgccataatccgtttctcatatttctttgtttcatggaatgacctctttatttttgtttcagttcgagataagttgcgggagatagtaggagcatccacaaactggaggtatgcatctttgttttcattcattcttttcatccccaaggtattatactacactgtatttaggctcagttgatggtctcacagtggggatggggagccctatgttcagagataggttgagaagtattttgcttgggggagaaggtcaacatttcaacatactcatcagatgacacctcattgtcatgaaagaagatgatttacgtatattctgcattttcaaagtgcatttaggtgtatattacttcactgattctcataacaaaacttgtgacgtgcttacgacatatgttcctgttcctttttttacacatgaaactgaaactcagagattgaatgattaaatgtcagggtttgggacttgaacccaagtcgctaagtttctctgtttcatgcaacttgactcctttattgcttcttgtcagttcaaaattagtcaggcctcccatattgtctttctctttctcgcagtatttccttgttgtaaagtaggatcatatccctcttggtgtacataattttgaggctaaaatgagatagaaaaaacacgagtgatcactagatatataataatctattgttggtatagaaattatctaatgacttatttttaaattctttatatgaaaaatttcactttactaaaaggtagaaagaatgaatacctgtgtacccaccacctggattccatacttattaatattttgccaaattttccaatatacacatattgcctgaaccatttctaagtaaattatagacaccatgacacttcagcgtgcatcttcagtaaacattttataaaaccagccttcgcttatctccaacaaataagacattctctcatgtaatcaaattgacagcaattccttgctagtatattactcatccatagtcacatttcctcaactgttaccattttgtgtaatagattactccttttaacaaaaatgtttttatagctgtttaaaaaacatcaagatccaataaaggattgcatgttgcatctggtggttatgactctttagtcttccctaatctagagtaatggacagtcgtccttcccctattcttcccccatgagcttgactttaaggaggccaagccatttgtcttgagaatgttccacattctggatttactggtgtcatttaactcattcctctatctcctgtagtttttgtagggtaaacatttctggaaataatactttataagttaagcttagaaagacatcttagctaatgttcttatcaacattgtcgttccgtatccccttgtctttcttttctctttcaccttaatcttctcttctttttcttccctttctgtctccttttcatgttatgttcttctttaccttttgttctgccttccatacttcctttggatatagtccattttccctcctctgtctctctttcctgaaattgaaggcagagagagagagagaactggggctcaaagaatccgagaactgtcaggtgagaaatgggaatataaagtagagtggccaagccattctttagcatatatatttatatgtatatatatatactattttgtccatctctctaaatttttaatttaatttcaaatattctggtctttgagtaaactttttgataagggtgaatatatggctcatttgggtatatctatatcagttttaagttttcttttttttttttttttttgagacagtcttgctctgttgcccaggctggagtgcagtggtgtgatcttggctcattgcaacctccgcctcccacgttcaagcaattctcctgcctcagcctaccaagtagctgggattacaggtgcccaccaccacacctggctaattttttgtatttttagtagagacggagttttgccatgttggccaggctggtcttgaacccctgacctcgtgtgatccacccgccttggcctcccaaaatgctgggattacaggcgtgagacactgcacctggccttaagaatgtttttaagcttgagaaatgataccggaaatgatcaatttcaccaagtggcaggtgggaagggagggaaggaagagaaggtgaaagtaggcccagaccttctttttcctcctttgatggtatcttactggcctgtgtaccactggaattgtgggctagaactgctcttgttttatgaatcctgcatcctttcttctcagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaaggtaacacagtgctatttttatgtatttgtttttatttccttgttttataacaattttgaaatataattcacacaccatacaattcgcctgtttaaagtgtacagttccatggttttgatatatttagagagttgtgcatccatcaccacagtcaattttagaacattttcatcaccctgaagtgtgttatttatttttaaagggagaccaacatgatttgcatttaattcactgtttgctttatttcacagatttggcaggattcttgaggatcttgacagcttgggaggtactggtattattttagtctttctaatagatacctacagatatacattgaattctgtgactggaaagggctcttttattctttaacctgcacagatgatgatattctaaagtgcacaaaaaaagaaggacatcggccgggcgtggtggctcatgcctgtaatcccagcactttgggaggctgaggcgggcggatcacttgaggttgggagtttgagaccagcctgaccaacatggagaaaccccgtctctactaaaaatacaaaattagccagttgtgttggtgggcgccgtaatcccagctacttgggaggctgaggcaagagaatcacttgaacctgggaggcagaggttgcggtgagctgagatcgtgccattgcactacagcctgggtaacaagagtgaaactccatctccaaaaaaaaaaaaaaaaaatggcatctactacttctgaattgtcataatttttttcttataaatgtagattcctatttaatggaggtatagtctgaataatctttcttactagtaactttaaaaaaagaaagtcttaaacttacagaaaagttgcaaatacagtataaagaatttttctgtggccaggcgcggtggctcacgcctataatcccagcactttgggaggctgaggcaggcagatcacaaggtcaggagatcgagaccatcctggctaacatggtgaaaccccatctctactaaaaatacaaaaaattagccaggcgtggtggcatacgcctgtagtcccagctattcaggaggctgaggcaggagaatcacttgaacctgggaggtggaggttgcattgagccgagatcgcgccactgcactccagcctgggcgacagagtgagactccgtctcaaaaataaaaaagaaaaaaattttttgtccctgaattatgtgagaataagtggctgacatgatgccacatcacccccaaatatttgaatatgtctttcctacaaacaaggacattcttctacataactacaaaacaaccataaaaaatcaggaaattaacactgatgtgtcatactgtctaatcctcaggtcccattcaacttttgccagtggtccttcatagcagaaggatccagttctgaatcatatgttgatttaattgtcatgtcaggactagttccttaatctttctttgactttcgtgactttgacatggttcttttgtgtattgtccctcaatttgggtctgtgtggtgcttcctcatgattagctttgggttatgcatctctggcaggaatgtcacagaagggatgctctgttcttattgtatcctatcaagtggtgcatggttttgatttgtctcattactgatgatatcagctttgcttactggatgacgatgatgtctgccactgttcttcactgtaaagttactcttttcccctttgtaattaataagtaccttatgtgggggggggtggcaggtaactttgagaccttcatcagactttcaattcattatttttaaatcagtatggactcaggaattcctatgttactgaatggactataatatgttactatcatctatttgatgttcacatgatcccaggagtgtcccagtcccttcaggctagcttctgtgtggttttctttgatgtgtccccattattctttgagcactttctcactttctggcacaataaaatattctaggctcatcttatgcttttccctgccccagtcctagaatcacccacatctccaaggagcccttttttgaaatggagaatgatattttgaagtggaggatgatattttgaaatggagatatgtgcgttgggagtggtcattattcctgggtatcactgctcccataccctcttagtggaggagctgggaaatatatgtgcatatacgtacatatatgttatttctaaatctttgtacagatgtatgtatgaaaaccatgggatcgcactgatagctccaattccagttcagccaccacggggttcattctcatttccttcctttccatatttgtaattcccttctccaactggctccattctccttaatatattgacttatttaatcagttccgctgtatgtgaccaatttcctatggctgccacccctcatgcatcatggatgctcccctcaccttacctgggctctggtaccccacaccaggtccccctctgcaggctcaccctcttcattgtgctcaagctgtgacatgctctgccatcactcttgcagcctctctgcaaggatgtcctcctcaccgtgcttggatgccagcaccctactctaggttaccttacttgctcccacctaatgatatttgggctgaatggttgggaaagggtctgaaaaagggttctaatatattgtttaaaaaactatttttttatagagatggggtctccctgtgttgcccaggtttttcgtgaactcctgggctcaaaggatcttcctgcctcagcctcctaaagttctgattacaggtgtgagccgccgtgcctggcctttttttttttttttgagacagagtctcactcttgttgcccggcctggagtagagtggtccgatcttggctcattgcatcttctgcctctgggttcaggcgattctcctgcctcagcctcctgaacagctgggattacaggcacccgccatcacatctggctaatttttgtatttttagtagagacggggtttcaccatgttggccagtctggtctcaaactcctgacctcaggtgatctgcctgcctcggcctcccaaagtgctgggattacaggtgtgagccaccatgccaggccctaacttttaaaatatagatacaagcttgttgttaagcttacgcctagcaactacttttctctagattaaataaacccagttaaaaattcttggctgggcacagtggctcacacctgtaatccttgcactttgggagatcgaggcaggaggatcgcttgaggccaagactttgagaccagcctgggaaacatagtgagtccccatctctacaaaacccaaaaaattagctgggcatggtggcatgcactagtagttccagctactcagaagactgaggtgggaggattgcttcagcccaggaagtcgaggctgcagtgagctgtggtgacaccactgcactacagcctgattgactttggtttgcttaggtgtccttatatatacaaactcccctgccactaccctctttcttgctcattaacttctgttgatggccagtccctttaacctgttcacttgattctattccttctatttcttcaaggaactgccttatcacttggctttctccctcatttcctgagccttttctcaacttcacttttccctcaagttataaacatattcaaggttcttccatcttaaaatgaaaaataggccgggcagggtggcttacgcctgtaatcccagtagtttgggaggccgaggcgggtggatcacttgaggccaggagttcgagaccagcctgggcaatatggtgaaaccccgtctctactaaaactacaaaaagtagccgggcgtggtggtgcgtgcctgtaatcccagctactcgggaggctgaggcacgagaatcgcttgagcctgggaggcagaggttgcagtgagctgagatagactccagcctggacaacagagcgagactctgtctcaaaaacacaaaaattagccgggtgtagtggcatgtgcctgtagtcccaactactcaggaggttgaggcaggagaatggcttgaacccgggaggtggaggctgcagtgagctgagatcgcaccactgcattccagcctgggtgacagagtgaggctctgagtcaaaaaaaaaaaaaaagataagtaaaaaatcctctttccttataacacctcacactttcttccttacttcatagctcactttctgaaaagaacctagaaaatcacctgctctcattgcctctttatgctaacttcctgttaattaaacatttcccggtcggctgtgttccggcttctgctcctccacgccattgaatctgctcttgccaagctcgccattggcccctttactgcacagttgaatggatacttttcagggctgacctgacccctttgtggcttcttatatcgtccagcccatccttgggctttggtgacatttccttctgcttctctggctgctcttttgtagtcccctttgtaggttcctctttttctgttgatcccttaaatgtaggttatccccagggttttgtcttctgccctttcaaaaactgattattttttgaatttattttattttattttgtttatttattttttttgagctgtagtttcgctcttgttgcccaggctggagtgcaatggcgctatctcagctcactgcatcctccatctcccgggttcaagggattctcctgcctcagcctcccatgtagctgggataacaggcacacaccaccacgcccggctaattttttgtatctttagtagagacggggtttcaccatgttggccgggctggtctcgaacttctgacctcaggtgatccactcgcctcggcctcccaaagtgctgggattacagacgtgagccactgcgcccggccttttgaattttataatttgttcatattaattaaattttaaggcattttaaaatttaacaataaaattgttaaatcttttaaaattatttatttagtttttgagacagggtctcactctgtcacccaggctggagtgcagtggcgtgatcacagctcactgtagccttgacctcctggctcaagcagtcctcctgccttagcctcctgagtagctgggactacgggtgcacaccaccatgcccagctaatttttttgatttttagtagagacaaggtctgccatgttgcccaggctggtcccaaactgctggactcaagggatccccccacctcggcctcccaaagtgttgggattacaggtgtgagccactgcgcccagccctattttttcagttgaggttaaaatataaaatttaccatctttatctttttttttttttttttttgagacagagtctcactctgtcacctagactggagtgcagtggcaccatctcggctcactgtaacctctgcctctcgagttcgagcagttctcctgcctcagctttcgacgtagctgggattacaggcatctaccacaacgcccagctaatttttgtatctttagtagagatggggttttgccatgttggtcaggctggtctcaaactcgtgacttcaggtgatccccccacctcggcctcccaaagtgctgggattacaggtgtgagccaccgcgcctggctcatctttatcatttttaagtgtactgatcagtggtaaaaactacatttatattacattttcctccgtctcttctctacccttcccttctgcccttttttgggttgacgttgcagattctctataaactcatctactcccagtgtttcagttgctatcagtatgctgaatacttacaaagctacattttctggcctgcttttctgagtttcaatcaatttttcctcttagctactagatttatttttcttttttagagacagtctcactctgttgcccgggctgtagtgcagtggtaaaatcatagcctactgcaaccttaaacttgcgggctcaagtgttccttctgcctcagcctcctgagtagctgggactataggcacactgcaccatgcctggctaatttgttttgtttttttggaatagggtcttgctctgtcacccagggtggagtccagtggtgcgatcaccactcactgtatcctcgacatctcgggctcaagcatcctcccatcttagcctctcaagtagctgggaccacaggcacacgccaccatgcctggctaatttttgtattttactgtagagacgggatctcaccatgttgcctgggctggtctggaactcctgggctcaagtgatccatctgcctctgtcttccaaagtgctgggattacaggcttgatccaccatgcctggcctaatttttaaagttttttgtagagacaggggtctcactctgttgcccaggctagtctcaagctctgggctcacgtgatcctcctgctatggccttgcaaagccctaggattacaggtgtgaacaactgtgccctccccaataccttcatttggatgtgccataggctcttcaaattcaacgcattgaaaatggcccattcttttcttcctatattctctttttattttgagacagagtcttactctgttgttcaggctggagtgtagcggcatgatcatggctaactacagtcttgacctcctgggttcaagcaatcctcctacctatctcccgagtagctgggactacaggcatgtgccaccacacctggctaacttttgtgtttttggtagagatggagtctctgctgtgttgcctgggctggtcttgaactcctaggctcaagtgatcttcctgccttcgcctctaaaagtgttgggattacaggcatgagccactgtgcccagtctctcttctctttttcagtgactagtacaccacgcttacctatgcaagctagaaaactgaatttattcaagtcttctcaggtttaccttcttcttaactcatagtcttttcatttctactcctgttgccataggttggagccatctgatttctttgctggacaaagacttttaaatggagtttattgcctttagcctatcattcccccagtgtgtcctttagcaggtgcatagatggaaggatttacacttactcaacaagtatttattgagccacatatcttgtctgagagtttgtgatacaaatttgaatggatcatgggggaagcagggagccaatcaacatataatcatacaacttttttttttttttttttttttttgagacagtcttgctctgttgccaggctggagtgcagtggtacgatctcggctcactgcaacctctgcctcctgggttcaattgattctcctgcctcagcctcctgagtaactgggacgccaccacgcccggctaatttttgtatttttagtagacatggggtttcaccatgtcagccaggatggtctcgatctctcgacctcgtgatccgcctgccttggcctcccaaagtgctgggattacaggctgagccgccgcgcccggcccaacgtataattatacgactttaaatgagttgatatctgtaaggtgcatgaaccatgcatggcacatataaatgcttgttaaaatatggaaagtatacagataaccacagggtggtataggagtcaagggtgttatggggaaggagggataactgagtgaaataattgtttcatgattaattaggacaaagccaggaggaaaacaggtagccaagtccttgtgctttgtttctctttcctgaagatgtttgatactgtcagactcatgtgctgagttcttactctgatttgggcactgagtctctgtggagtggtaacaagctgtctggtgggtctgggcttgcttcgggctttgatttcttcaccaaatcttaaaattgagggggcagtcagattggaggatctcccaaatccttcaatttataaaagtgtttgatcctaggataagatgatcaatggaatattaggggctggatcttccaagcgagacaaggcttttcatggatctcagggaggaaattttaaatgttgggaaataattctgcctttttaaaatttggtacactcctgtttccctgcagttcttatttgttacatgcacaacaaaatccactccgccaagatgtctcctttatcgatagttacagccctggtggataagattggtaagtgatatcattttctatgcatacttagaattcttagtaatttcaagatattattgagattacaggacgtactctccttttatgggaattttttttttttttgagacggagttttgctcttgtcacccaggccggagtgtaatggcacgatcttggctcactgcaaccttcgcctcccaggttcaagcaattctcctgcctcagcctcccgagtagctgagattacaggcatgtgccaccacgcccggctaatttttgtatttttagtagagatgggattacaccatgtcggccaggctggtctcaaactcctgacctcaggtgatccacctgcctcggcctcccaaagtgctgggattacaggcatgagccaccgtgcctagccctttatggggaattttaatgtatatatgcatatgaaaatgtctagaatgctgtataccaagatatttattataattaggtgggttttgcatgattccagttttattttttatattctttgctttttctacatttttcaaaaacacatgtagatttcttctgcgtgtcaaaaaagttattttagttttgaagacaaaaaagaaatgtagtggaatttgccataatttctaattgttcatatttacagaacagaaaatttttggtatgacttggaccctgattgacttctgttttgcagatatgtgtaagaagagcttgagcccagaacaggacattaagttcagtggccatgttagctgggtcgggaagacatccatggaagtgaagatgcaaatgttccaggtaaatatgcgcctgaagattgtccactgtttaagtaaaaccagctagtctccatgcaagaaaagcttatttacctatgtatctgtagacaggtatgttgctcactgcttctagaaaaacagttgaaagctcatgtcatatggatggtgggttattaatatcctccttgtggacaaagcctgacgtactatttggtgtttatatttaatatttatttctaatcatatacaagtccatgttaaggtgtttgtttctggttctgcctaggagaatttcacagaagtctgtgttatggtaggagtgaatggaattgattactgtattcatttcccaggactgctgtacagttggccctctgtgtctgtagatttcacatccacagattcaaccaaccatggattgaaaatgtttggaaaaaaacagtgaaaaataatataaataaaacacaatacagtataacaaccatttttttaaaaaaatagagatggggctgggtgcagtggctcacgcctgtaatcccaccacgttgggaggctgaggtgggcagatcacttgaggccaggagtttgagaccagcctggccaatatggtgaaaccctgtctctatttaaaaaatacaaaaattagccaggcttggtggtgcacgcctgtaatctcagctacttaggaggctgagggttgggaaccgcttgaacccaggaggtggaggttgcagtgagctgagattgcgccactgcactccagcctgggcaacagagtgagactcgtctcaaaaaataaataaataaataaataaaaatagagaaatggatatggagtttcaccatgttgcccaggctggtcttgaacttctggcctcatgtggtcctcccaccttagcctccccaaatgctgggattacaggcatggctggccttaaaacaactatttatatggcatttatattgtattaggtattataagtaatccagagataatttaaagtacacaggaggaggtgcataggttttatgtaaatatgaccccattttatataggggagttgagcatctgtggattttggtattggcgggtggtggtagggagttctggaaccaatcctgcgtggattccaaggggcagcggtaccacaaagtaccataaactggtggcataaaaacagaaaatgtattgactcacagtttggaggctacgaatccaaaatcaaggtgtcagcagaggcatgttccctctaaaacctgtaagagagaagccttccttgtctgtttcttgcttctggtggtttgctggcaatccctagcgttccttggcttccagctgtagcacttcattcagtctctgcctccgtcatcacatggtgttctctcatgtgtctctgtctctctggtgtctcttgtcaggatgctgctaatcatactggattaagggcccacgctactccggcatgacctcatcttaactaattatgtctgcaacgactctatttccaaatacagtcacgttcacagttatgggggttaggatttccacatgtctttttgggggacacagttgggcccttaacagtcatttgagctattacagtagttaggaacagctaatctgatgagtaaaactcagaatagctattacaaacaattgaagaaatttgacaagaaaaagtacctcaaagaggataacaacacagaaataaaatgattcagtgtatgtccaagatttcattgtggaaaacttatttaagaatgactggctgggcgcggtggctcacgcctgtaatcccagcactttgggaggccaaggcgggcagatcaccaggtcaggagatcgagaccatcctggctaacacggtgaaaccctgtctctactaaaaataaaaaaattagccgggcgtggtggcgggtgcctgtaatcccagctatgggaggctgaggcaggagaatggcgtgaacccaggaggcggagcttgcagtgagccgagatcacaccactgctctccagcctgggcgacagagcgagactccgtctcaaaaaaaaaaaaatgacttattcatttatgccagggtattgagtagaccaggggtccccaacccccgggccatgggctacatagcaggaggtgagctgtgggcaagagagaattaccacctgagctccgcctcctgtcagatcagcagcggcattagattctcataggagcacgaaccctatcgtgagctgcgcatgtgagggatctaggttgcacactccttaggagaatctagtgcccgatgatctgaggcggagcagtttcatcccaaaaccatcccccccagcccaccccattccgtggaaaaattgtataccacaaaactggtccctggtgcaaaaaaggttgggggccactgcagtagacctattattcagatgcattttttcctgctatggaatgatgaagcatttcaccttttggtgaaataaactttcacactttcagaaaaagcctgaagctagctctgtagtagttatttgtcaaaataagtattttttttattcagtactatatgcaagtgattgaatctttcaattcccatgtttgatgtaactgacagtaatactgttttattttgtttgtttgagacagtgtcactctgtctcccaggctggagtgtagtggcgcgatctcagctttctgctacctctgcccctcgggttccagtgattctcatgcctcagcctcccaagtagctgggactacagatgtgtgtcaccatgcctggctaatttttgtatttttagtagagacggggttttaccatgttgcccaggctggtcttgaactcttggactcaagccatccacccgccctcgcctcccaaagtgctgggatttcaggcgtgagccaccgtgcccagccagtaatactgttttaaaaacaaaacattgctgggttgctgctatgatctgcctacagtctttttttttttttttttttttttgagacggagtcttgctctgtcacccaggctggagtgcagtggtgcgatctcggctcactgcaagctccgtctcctgggttcatgccattctcctgcctcagcctcccaagtagctgggactacaggtgcctaccaccatgcccggctaatttttttgtatttttagtgcagacggggtttcaccgtgttagccaggatgatctcgatctcctgacctcatgatccgcctgcctcggcctcccaaagtgctgggattacaggcgtgagccaccgtgcccggcctgttctgcctacagtcttttaaaaaatattcttggttaattcctagtctgctcagtgccatgcacagcagattcctggcacaggacctgccttttagggcatcttgacaatttgcctcttggacaaataggttgaaaaagagatacaggaattattgagagagaaccagtggaactcagtgtcagacaagtaaacacttttgttttaaatttgcattcttcactggctatttgactaataactcatgactcgagtgatcctttttattccagagaagtggtgtggggataagcactctgcctctggtttgcatagatttaggttctaatcccagcactgctgcttcctagtcatgtggctgtggataaaccacttgtctgagcctctgtgttctcaaatgtaacatgaaaatagtaacagagtaccatgttatatggttgtggtaagggaaatttgaaaaaaacccattcatgtgaagtactttggtacagtgcctatcacacagtaaccactgttggaaatttttttttttttttgagacagggtcttgttctgtcacccaggctggagtgcagtggcatgatctcggctcactgcagcctctgcctcctgggttcaagcaattctcctgtctcagcctccctagtagctgagattacaagtgcacaccaccatgcgtggctagtttttgtattttttatacagaccgggtttcaccatcttggccaggctggtctcgaactcctgacctcaagtgatccgcctgcctcggcctcccaaagtgctggaattataggcgtgggccgccgcccccagcctggcaataatattaatttattataaatactgttgaggtggcctcaaatttctattttgggcttgaccttcatacccactttcctgagtgctccttatatttctccacctagacgtgctgttgctacctcaagttccaataaacagtatgttccaaactgattggccccaattctcatcctcctccagtcttccctttgccagcctcctgcttcctttcccatgcagccttttgccaggtcttgcaaattcatcacccacagcaactcaccagaattctttctccccatatccttttggccctgtgttttattcaagtcctcactgcctcttgtgtgagtgccttaaccgtcttttaattaacctgactttctctagccggacctctctcttttaattttatgcatttttaccacataagtcttccaaagctgatcttgaatcaggtcacttcccttctcagaaaccttcagtgaccattcattatctctggattaaagtctaaactcctttgactagcccaggtgcagtggctcacggctccaatctcaggactttgggaggccgaggcaggtggatctcctgagctcaggagttcaagaccagcctgagcaacatggtgaaaccccgtctctacaaaaagtacaaaaaactggctgggcgtggtggccatgtctgtaatcccaacactttgggaggccgaggcaggcgaatcatgagttcaggagtttgagaccagcctggccaatatggtgaaatatcccatctctactaaaaatacaaaaattagctgggggtggtgccacgtgcccgtagtcccagctactgcggaggctgaggcagaagaatcgcttgaacctgggagatggagttttcagtgagccgagatagcgccactgcaccccagcctcggcgacagagtgagactcggtctcaaaaaaaaaagtacaaaaaattagctggtgtggtggcgtgcgcctgtgatcccagccactcgggaggctgaggtgggaggatcgcttgaggcaggggggtggaggttacagtgagccgagattgcgccactgtactccaacctgggtgacagagtgagaccccatctcaaacaaaaaacaaaactcctttgattaattagggcccaaggggcttcataaactagccccagcctacctttccaactatattccctttgacttgtcatttatataccttcttaatgctcaccactggccttcaagcatcgtaagaatagggagttattcatgtttgcgttctagtgcttggcactagtgggtattcatgatagtaaaccataacttacataggttgagcattgcaactctgaaatctgaaatgctccaaaatctgactttgagcactgacatgatgcccaaaggaaatgctcattgggtttggaatgttcaacctgtaagtattgaatgcaaacattccaaatccaaaaatcgaaaatccaaaatagtctggaatacagaacacttctggtcccaagcattttggataagggatattcaactgggagtgagtgaatgagtataattgctgatgctttttcttttgcctgaaattctcgtgctctggctctgtatccacattctttctccctgtgctccaggataacttcatgctcaatcctttccttattctcccagcatgtaacacctgttcctcaggcctcctccctcaataccgtctctttgacttgctctcctggcacctgctagtctcctacagagctgtgcatgaatatgtcttttctcttccactgcggactctactcctcaacgataggacctgggtttgagtcacctagctcacttcctgacatccattcatttaacattcatttagcaatcatttattgagtgcctgtcctgtgccaggcatacagcagtgagcaaaacagataaagttccattctcttggagttgacattctagtagtgcctagaacctgcctccttcattcattggcaaatattgatcaggtatctgctatttgctggtctttgtgctaaatactagggatataactgggggaaaatggtctttgtcctacaggagctcacggtgcagtagggagacagtcacataaacaaatggttatgatatagtatatcgttatgcagtatttttcaacagggacactgttggcatttctggtgggagcattcattgttctgcaggtctatcccctgcattgtgagggatttagctccttggttacccccctccatagtaatgccccccaagttatgtgacaacaaaaaccactctgtatttttcaaatgcccgcctattagagtgacatctacttctcttacattgagaaccactgtcaagagaggactgtttctattaagggggctgaatgaaggaggcaaagataaacttggtctggggaatagggatgggggaggggaggaatgtcgtgaagaatgaggctgctgaggaaggcatcaggtaaagatatagacaggaggcagtcaacagcctgttctatcccaggacctctcagttgttagttagctatggctagagaaaaaggtgcaggtatgagcacagtatttggtgaacaactggggagcaatcgtgggctctgttgtggagggctttatatgccacgctaacaggattagcccaggtgctggtggaagaaaggaggaactattgaaaggtttgaatagggcagaggcataatgagattggtgagactgttcctgcaattgagggggagggcagtagtgatgaggcttgtatcatttattgaggagggaacccaatatactctcaggttataaataacttctgtcattactttatggtatgactttcctggaagtacagacttctaggggataaagaaacatcttaaggcccaggcatggtggctcatgcctgtaatcccagcattttgggaggctgaggctggtagattccttgagctcaggaggtcaagaccagcctgggtaacatggaaaaccccatctctacaaaaattagctgggtgtggtggtgcatgcctatggtgtcagctagtcaggaggctgaggtgggaggattgcttgagcccatgaggtcgagactgcagtgagacatgatcatgccactgtactccaacctgggtgatagagtgagaccctcttcctggggagagaaaaaaagaaacatcttaaaacctcagaggcctatgcattgtaaatacaggttgagtattccttacctgaaatgcctgggaccagaagtgtttctgatttcagaatatttatatttactggttgagcattcctaatcccagagttcaaaatcttgaaatgctccaatgagcatttccttgagtgtcatgtcagtgcttgaaaagttttggattttggagtattttttatttttggattagagatgctcaacctgtatttaacttaacccacataatcatctttgattttacctcttcttgggagctcctgtgcccagctatgaaggcataaactgtgctagtggttggcacactacagttccctgaaacatactagtgtttgtgagcatgatgggaggtccgtctgggtaggtgtgccatcaggaggacaggcacgccctgcaagaagctcagattctgaggaaagcaggcaaattaaacgctgatgatactctctgtgacccttgcctttgggtcccagtcttgcacagttccaaactccatgccagcagcccatctcatgcagtatactatttgcgttttgtttgttttgttttggagatgggatgttttctgtcatccaggctacagtgcagggtcgtgatcatagctcagtgcatccttgaactcctgggctcaagggatcctcctgcctcagcttcccactagctggtactacaggcatgcaccaccatgcctggctaattttttaatttttatttgtagttagagaccaggtctcgctatgttgcctaggctgatctcgctttcctggtctcaggcaatcctctcatctaggcctctcaaaatgctgggattataggcatgaggtaccatgcccagcccccgattggactttgaggtatttttctcctctgctaggccacgggctcctttgtcatcctgccattctgagagcctagtgctgtgcctggctcagggtaggcccttagcagacggtggttaatgagagtgcttctcttctttttccagttgcaggctttctctctctctctctctcttttttttttttctttttttttttttagacaggggcctgcaatctcggctcactgcaaccttggcctcctgggttcaagcaattctcatgcctcagtctactgagtagctgaggttagaggcatgcgccaccacaccctgctaatttttgtattatttagtagagacagggttttgccatattggccaggctggtctcaaactcctggcctcaagtgatcctcccaccttggcctctcaaagtgctgggattataggcgtgagcgactgcacctggccagcatacataccgtctgttagaatcgtggtaggtcttcccgataaatccatttctcatatgtacattttctttcctttgttcttcagttacatggtgatgaattttgtcctgttttggatgcaacatttgtaatggtggctcgtgattctgaaaataaagggtaattgctattttttcataattctttattttgaagaatttcaaagatacataagactggagagaaaactataatgaatgtccatatacctatcacttggacgtaacagttttaattgcaatttcttggccatttttattttaaggcaaatcccagacatgacatttcactcttaaatacttcgggcatcttttaaaaaatgagaatattctcaggccgggagaggtggctcacgcctgtaatcccagcactttgggaggccaaggctggtggatcacttaaggtcaggagttgaagaccagcctggccggcatggtgaaaccccatctctactaaaaacacaaaaattagctgggcgtggtggcacgcgcctatggtcccagctactggggaggctgaggcacgagaattacttgactctgggaggtggaagttgcagtgtgccgagattgcgccattgcactccagcctgggcgacagagcgagactccatctcaaaacaacaacaacaaaaagagatgttgcacaattctgtgaatacactaaaagccgttaaattgtacactttcaatgggtgaattgtgtggtatgcgaattataccttaataaagctgttatcaaaaaaaaacagacttacagacataaaaatcaaatgtaattttttgttaggcatgacaatagtaatgtagttacttaagagaatattatcctttttttttttttttttttaagatggagttttgctcttgttgcccaggctggagtgcaatggtgggatctcggttcactgcaacctccgcctcctgggtttgagcgattctcctgcctcagcctcctgagtaactgggattacaggcatgtgccaccatgcctggctaatttttgtatttttagtagagatgggggggtgtttcactatgttgcccaggctggtctcgaactcctgacctcaagtgatccacccacctcagcctcccaaagtgttgagattacaggcgtgagccaccatgcccagctgagttgtgcaatctcttaaatctgttttaatccagaacagttgtgtcttcccctattgtttcttattcactcgttgagaggctggatcatttgttctaaatagtgtcccactttctggatttgttctattgctttctcatggtggtttgtttgtttgttttttgatcttgtttctctatccctagtaatttctctaaactgaagttagatctaaagccttgtattagatttaggttgagcatatttggtgagagtactacatagatgatgttgtatatctcgtatttcatattgcatcgtatcaggaggtacaggttgtcccactcacagtgatgctaagattagtgtgtgggttcaagcagttacagcctaatctctcctttgtgaagttcagtttttcctcttctgatcagcaacaatctacaggggtgtactttgtcatcctgcaaatagctgagtttcccatcagtctttttccagtgctttcaatgtccactgctgatcattgctttaattagtatcattaggcagtttagagtaattctcaaattttgtcattccttctatgtttgttagctggaattctgtaaagaagagcgttcccttaacaactagggcgattgggtttgaaatggagttaggatcaatgcttcattcttgtcttttatttacatgttttcagaataaggagttggttcactagctagtgatgacatgcttttcccagttttttagctttttagaaaagtatcatgtttttaaatttctttttttttttctgtgtgtgtgtgtttttgagatggagtctcgctcagtcacccacactggactgcagtggcgcaatctcggctcactgcagcctctgtctcctgggttgaagagattctcctgcctctgcctcccaagtagctgggactacaggcatgccccattatgcttggctaatttgttttgtatttatagtagagacggggtttcaccatgttggccaggctggcctcgatctcctgacctcaagtgatctgcccacctagggattccaaagtgctgagataacaggcgtgagtcatttcgcccagcccgttttttttttgtttttttattttttttgagatgaagttttgctcttctctccaggttggagtgcattgtcatgtgtcatgagcatggctcactgcagcctgggcctcctgtgctcaagcaatccttccgcctcagcctcctgagtagctgggaccacaggcacataccaccatgccgagctaattttttttctttctttctttttgagatggagttttactcttgttgccccggctggggtgcagtggcgcaatctcggctcactgcaacctccacctcctggttcaagtgattctctggcctcagcctcctgagtagctgcccagctaatttttaaattttttgtagagatggggttttgccatgttggccaaactgatctcaaaatcctgggctcaagtgatcctctcacctcggcctcccaaagtgctaggattacaggtgtgagccactgtcctgccagaaaagcatcattatgaattcatggttgtaatatattacatgtatttcaataaattgcagccattgtttctcttgatgctccaagtgtgccttctttgggcggtgggagttcctctaagctggctcctttccacctgtctgtttgatagcttcctgctgtctgacacaagatgtcttgggctcatcttacgtatttcctgccccaggcctggagtcagccatttctccaagtagtcctggggttccttttagtgggaactggtatttagacatcaaaatctgggcactagaactgtacattgttactagtttgttattgtttccaggcctttttagtggacagagctaggatatattttaaacaaacaaaaaacctcatgagagctgggtgtggtggctcacgcctgtaatcccagcactttgggaggccgaggtgggcagatcacttgagcccaggagtttgagaccagcctggccaacatggcgaatccccatctctactaaaagtacaaaaaaattagccaggtatggtagcatgtgtctgtagtcccagacgatgtgggaggctgaggtgggaggattgctttaacccgggaagcagaggttgcagtgagccaaggtcgcaccactgcacgccagcctgggcgacagggcaagaccctacctcaaaaaaagagcctcatgagtttatatggtcattttcaagtcatttaaccatatagacttcaacttactttacgtcatcttttttctctgaaattgaattcttggtttctaacaacagttacacccaaactgagaaaaactaattgtgggggtagagctggggtgggagggattgctctttgcacaggacagagtccagtggcctgtgggaaatctcatttgtattagaaacttgatttaggagtctgcagtgaaaaatctttgctgctgcgtggaaagctgacttggaaagccaaattaagatagaaaaatatgttggtcccttagtgatctgagggaagaataacacccatctactctggcccttcctgccagccccagctgacctgctgtggccagtgactggcctggggcttgtattcaagcactgaggccactgctgcaagtttcactcccagctgatgcatgtcactttcccaagctgttgtttcaattcttttgttttttgttttcaagacagaggttggctcttgtcacccaggctggagtgcagtggtgctatctcggctcactgcaacctctacctcctgggttcaagtgattctcctgcctcagcctcctgagtagctgggattacaggcacctaccaccacacccggctgacttttgtatttttagtagagacggggtttcaccatgttgaccaggctggtctcgaactcctgaccttaggtgatccacctgccttggcctcccgaagtgctgggattacgagcgtgaaccactgcccccggcctgttttaattcttttgtttccattgttgtttcatcaaatcttttgattctaccacagtgaaatattatcccttttcccttattttttatttcaaaaaatttgatgcttacagaaaagtagatagaataatgcaacaaacgtatgcctttcacgtaaattgtattacatttgcgtaattctcttaccctctctctacaaatacacacatttacatattttttcccatgaatcattggaaagtaagtttgagactgcttcacccattcaggagttcagcatgtatttcctaagaaccaggtatttctccataacctcaatgcctttattatatctgagaaattcaacagtgatacagttatttaatatgtgatccgtattcagatttcaccagttgtccctaaaatgtcctttatagctatcttcctgattcaggacccaatccatcaaggattgtatattgcatttggttatcctgtttctttagaatagtctctctgccatttgctgtctttcaaaaattgatatttttaaagagttcaagccagttttctttttcttttttttttttttttctttttttgagacagagtttcgctcttgttgcccaggctggagtgcactggcacgatctcggctcaccgcaacctccacctcctgggttcaagcaattctcctgcctcagcctcccgagtagctgggattacaggcatgtgccaccacgcccggctaattttgtatttttagtagaaacgaggtttctccttgttggtcaggctggtctcaaactcccaacttcaggtgatccccacccggcttggcctctcaaagtgctgggattacaggcgtgagccaccacgcccggcctaaagccagttttcttgtagagtgttctacaacctatatttgactgtttcctcatgattagaatcaggttaaacatttagcagatgccagtatcctttttataatgttaagtttctagtgtgcaattaaggctgtaactgtaaggcttccctaattgttccagcgttcacatgtaaggcaagcagtaagcactacccaaaatgaaaagcagattctttaaaagtagtaggtgattgttcatcttcaagttttattagataatggcatatcttaaattatattcttttttttcttctttttaggccggcatttgtaaatccactcatccctgaaagcccagaggaagaggagctctttagacaaggggaatgtacattaatttgtttataataaaataaatttgaaaagcacattaattacgctgcagaagagattatttaagattttatatgggctcttcataccagtcaaatgtcttttttttgtttgtttttttgtttgttttttttgaaatggagtctctctgtctcttgccaggctggagtgcagtggtgccatctcggctcactgcaacctctgcctcctgggttcaagtgattcttctgccccagcctcctgagtagctgggactacaggtgcgcgccaccacacccagctaatttttgtacttttagtagagatggggtttcaccattttggccaggatggtctcgatctcctgaactcgtgatccgcctgccttggcctcccaaagtgctgggattacaggcgtgagccattgtgcctggcccaaatgtcttattcataccaataatttattgaaattaaaaatatgctattcttttttctttggagtccatactttgaatgattttattgatcagacaatatttattaagtgaagtaatttgttatctccgttttttttttttagacagttcttgctctgttgcccaggctggagttgggcttgggtccaggagtttgaggctacaatgaacaatattgtagtctcgatctcctgggcccaagctatccacccacctcagcctcctgagtagctaggactataggcacgtgccaccatgcctggctaattaaaatttttctttgtagagacaggggtctcactatgttgcccaggctggtcttgaactcctggactcaagcaatcctcctgcctccgcctcccaaagtgttgggattacaggcatgagccactgcacctggcctgttttctccgttttaatgaagtgagaaatgcatctcaatgggataactgcaggtcagggctctggatcaggatgatatcaagtgatctcacactgaaccaatataatttccatgtggaaccaaagactcactgggagttttatgtggcctctgcagttttctcttggatacgtgtataattttcagtgagattttgaaaggcatcccaggtcagaataccgtgtgctgtagtgcgaccgtcctgatcattgctccttattctcccttgttccagtgaacaaggggagaagaattgccttcagctccacgtcgttactgaaaatggcccccagcgctgaggagaggaccaccatacatgagatgtttctcagcacactggatccaaagtaaggatggtgagattccacgttgggaaaacatttaaaccttggccttttttttttttttttttttttgagacggagtttcgctcttgttacccaggctggagtgcaatggcacgatcttggctcactgcaacctctgcctcccgggttcaagtgattctcctgcctcagcctccgagtagctgggattataggcatgcacctccacgcctggttaattttgtatttttagtagagacggggtttctccatgttggtcaggcttgtcttgaactcctgacctcaggtgatctgcctgtctccacctcccaaagtgctgggattacaggcgtgagccaccacacccgaccttttttgtttttgagatggagtcttaccctgttgcccaggctggaatgcagtggcgtgatcttggctcactacaacctctgcctcccgggttcaagcaattctcctgtctcagcctcccaagtagctgggattacaggcgcccgccaccacgcctgctaattattttgtatttttagtagagacggggtttcaccacgttggccaggctggtctcaagctcctgacctcatgtgatctgcctgcctcggcctcccaaagtgttgggattacaggcgtgagccaccgcgcctggcctaaaccttggccttctccagagccacagttgtctgagtgtattgggagtgacttgcaaatgtttttacttttcaacaagagaaccatggcattaacagggtttaataaatattcatttgtacaggactataagttttcggagtcgagttttaccctctaatgcagtgtggatggagaattcaaaactgaagagtttggaaatttgccaccctcaggtattataatttagtgagaaatccgaataggatagcttccgttcatgatatttgtccaagatttgacacacctttaaactggcctttgtcctgtggcattgttaattcctctgttctgtatacaaaggtggccataagttttgtatttattgatatttatttatgtcctgtaggagcggaacattttcaatcggatctttggtggtttccttatgaggaaggcatatgaacttgcgtgggctactgcttgtagctttgggtgagttacatgtaaggcagccttaacttctgagaagcaatttatatcaccccactgaaatgaaacatttcggaccagtctgggtgtgtgtgggaatatgttatgtttttgaatgaataccacactgataccagctgaatttgatcttcattttagaaggttgtttctctgactttgtaagttcatacattaaaaaaactactgagaaaatacagtgatgatatgtagaaaggaaaagatatagttattttggccctaatctgctcacgatggcgtctcttaccatttctcactggtaggatcttttcccccttctctaactttattcttcgttcatttttattttgcttcagctagttgttagaggaaacaattgagatcatctgaattttgcaatataccccaaattctgtcctttcccccaacagtggttctcgaccgtttgtggtagcagtagatgacatcatgtttcagaaacctgttgaggttggctcattgctctttctttcttcacaggtaggtgtgtgatgagagatgacatacaacttttttttttcatttgagcctagaagtttctatatcaaaaagccactgttttctcttatgactgcctttttccccttcctaatgcagttgactgattatagtgtctataatctgttaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggaggtaagtagtgattattgcttgtccctaacaaagggaagaacttctaaggacatttttctccttttgaattggaggaagtgtattgatgcctgtcagcacaagagcatgtcttcaggagattttgcttttgagatttggcagccctgaaggccaaagatgcctgtggcccccaggcgggcaagcaaccactggtagtcaaaaactgatccagccaggctgggcgtggtggctcatgcctgtaatcccagcactttgggaggccgagacgggcagatcacgagttcaggagatcgagaccatcctggctaacacggtgaaaccccgtctctactagaaaaaaaaaaaaaaaaaaaaaattagccgggcacggtggcgggcacctgtagtcccagctactcgggaggctgaggcaggagaatggcgtgaacctgggaggcggagcttgcagtgagctgagattgtgccactgcactccagtctgggcaacagagcgagactccgtctcaaaaaaaaaaaaaaaaaaaaaactgatccagccaaaggaaggggacaggagtcatggcctgctcctttgggaatgtggcacaccccggcccaacagtgtatcttgttctgtcccagtgttcccaagtagtcttgtgtttgtatgatgatatgatggttttctacggtattacaagtttctccaaggttctctttcttgtgtttcagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatacttt

SEQ ID NO: 3300 - DNA, 2408 bp, human
atggatcgagatttagaacaggctctggatcgcacagagaatatcactgaaattgcccaacagagacgtcctagaaggagatactcacctagggcgggaaaaactctgcaggaaaaactttatgacatttatgttgaagaatgtggaaaagagcctgaggatcctcaggaattgagaagcaatgtaaacttgttagaaaagcttgttaggagagagtccttgccatgtttactggtcaatctatacccaggcaatcaggggtattctgtgatgctccagagagaagatgggtcctttgcagagaccattcggctgccttatgaagaaagggcattgctggactacttggatgcagaagaattaccccctgctttgggtgatgtcctggataaagcttcggttaacatttttcatagtgggtgtgtcatagtagaagttcgtgactacaggcagtccagtaatatgcaacctcctggttaccaaagcaggcatattcttctacgtccaaccatgcagactttagcccctgaggtgaagacgatgacaagagatggcgagaaatggagccaggaagacaaatttcctcttgagagtcaactgatcttagcgacagctgaaccactgtgtcttgatccttctgtagcagttgcctgcactgcaaacaggctgctgtacaacaagcaaaagatgaataccgacccgatggaacagtgcctccagaggtattcgtggccctctgtaaagccacagcaggagcagtctgactgtccacctcctcctgagctgagagtgtcgacttctggccaaaaagaagaaagaaaagtaggtcagccttgtgagctgaacattactaaagcgggaagttgtgtagacacgtggaaaggcagaccctgtgatttggccgtgccttcagaagtggatgtggagaaacttgctaaagggtatcagtccgtcacagctgctgacccacagctcccagtctggccagcccaggaggtagaagaccctttcagacatgcatgggaagctggctgtcaggcctgggacaccaagccaaacatcatgcagtcgtttaatgatccgcttctctgtggtaaaatacggccacgtaaaaaagccaggcagaagagccagaagtctccctggcagcccttcccagatgaccattcagcttgtctcaggcctgggtcagagactgatgctgggagggcagtgagtcaggcccaggaatcggtgcagagcaaagtcaaaggtccaggcaagatgtcacacagctccagtggcccagccagtgtcagtcagctctcttcatggaaaacaccagaacagcctgatcctgtgtgggtccagtcttcagtatccgggaagggagagaaacatccacctccccgcacccaacttccctcaagctcaggaaagatttcctcaggtaacagttttcccccacaacaggcaggcagccctcttaagcgtccatttcctgctgctgctcctgctgtagctgctgctgctcctgctcctgctcctgctcctgctgctgctcctgctttagctgctgctgctgtggcggcggcggccggtggggcggcaccaagccattctcagaagccctctgtgcctcttattaaagctagcaggcgccgtccagctgccgggcgccccaccagattcgtaaaaatagccccagccattcaggtccggacaggctccactggcctaaaggccaccaacgtggagggcccagtccggggagcccaggttttggggtgcagtttcaagcctgtgcaggcccctggctcgggtgcccccgctcctgcaggaatcagtggcagtggccttcagtcctcaggaggtccactaccagatgcaaggcccggtgcagtgcaggcatcttctccagcaccccttcagtttttcctaaatactccggaaggtctcaggcctctgacactccaggttccgcagggctgggcggttctgaccggcccgcagcagcagtcccatcagctggtttccctgcagcagctccagcagcccacagctgctcaccctcctcagccagggccacagggttccacactaggtttgagcacgcaagggcaggccttccctgctcagcaacttcttaatgtgaacctcactggagcaggtagtggtctgcagccccagccccaggctgctgtgttgagtctgcttggctctgcccaggttcctcagcagggtgtccagctcccctttgtcttggggcagcagccacagccgctgctgctgctgcagccacaaccacagccacagcagatccagctccagacacagcctttgagagtcctgcagcagccagtgtttttggcaacaggcgctgttcagatagtgcagccacatccaggtgtgcaagcagggagccagtt

SEQ ID NO: 3301 - DNA, 2453 bp, human
atggatcgagatttagaacaggctctggatcgcacagagaatatcactgaaattgcccaacagagacgtcctagaaggagatactcacctagggcgggaaaaactctgcaggaaaaactttatgacatttatgttgaagaatgtggaaaagagcctgaggatcctcaggaattgagaagcaatgtaaacttgttagaaaagcttgttaggagagagtccttgccatgtttactggtcaatctatacccaggcaatcaggggtattctgtgatgctccagagagaagatgggtcctttgcagagaccattcggctgccttatgaagaaagggcattgctggactacttggatgcagaagaattaccccctgctttgggtgatgtcctggataaagcttcggttaacatttttcatagtgggtgtgtcatagtagaagttcgtgactacaggcagtccagtaatatgcaacctcctggttaccaaagcaggcatattcttctacgtccaaccatgcagactttagcccctgaggtgaagacgatgacaagagatggcgagaaatggagccaggaagacaaatttcctcttgagagtcaactgatcttagcgacagctgaaccactgtgtcttgatccttctgtagcagttgcctgcactgcaaacaggctgctgtacaacaagcaaaagatgaataccgacccgatggaacagtgcctccagaggtattcgtggccctctgtaaagccacagcaggagcagtctgactgtccacctcctcctgagctgagagtgtcgacttctggccaaaaagaagaaagaaaagtaggtcagccttgtgagctgaacattactaaagcgggaagttgtgtagacacgtggaaaggcagaccctgtgatttggccgtgccttcagaagtggatgtggagaaacttgctaaagggtatcagtccgtcacagctgctgacccacagctcccagtctggccagcccaggaggtagaagaccctttcagacatgcatgggaagctggctgtcaggcctgggacaccaagccaaacatcatgcagtcgtttaatgatccgcttctctgtggtaaaatacggccacgtaaaaaagccaggcagaagagccagaagtctccctggcagcccttcccagatgaccattcagcttgtctcaggcctgggtcagagactgatgctgggagggcagtgagtcaggcccaggaatcggtgcagagcaaagtcaaaggtccaggcaagatgtcacacagctccagtggcccagccagtgtcagtcagctctcttcatggaaaacaccagaacagcctgatcctgtgtgggtccagtcttcagtatccgggaagggagagaaacatccacctccccgcacccaacttccctcaagctcaggaaagatttcctcaggtaacagttttcccccacaacaggcaggcagccctcttaagcgtccatttcctgctgctgctcctgctgtagctgctgctgctcctgctcctgctcctgctcctgctgctgctcctgctttagctgctgctgctgtggcggcggcggccggtggggcggcaccaagccattctcagaagccctctgtgcctcttattaaagctagcaggcgccgtccagctgccgggcgccccaccagattcgtaaaaatagccccagccattcaggtccggacaggctccactggcctaaaggccaccaacgtggagggcccagtccggggagcccaggttttggggtgcagtttcaagcctgtgcaggcccctggctcgggtgcccccgctcctgcaggaatcagtggcagtggccttcagtcctcaggaggtccactaccagatgcaaggcccggtgcagtgcaggcatcttctccagcaccccttcagtttttcctaaatactccggaaggtctcaggcctctgacactccaggttccgcagggctgggcggttctgaccggcccgcagcagcagtcccatcagctggtttccctgcagcagctccagcagcccacagctgctcaccctcctcagccagggccacagggttccacactaggtttgagcacgcaagggcaggccttccctgctcagcaacttcttaatgtgaacctcactggagcaggtagtggtctgcagccccagccccaggctgctgtgttgagtctgcttggctctgcccaggttcctcagcagggtgtccagctcccctttgtcttggggcagcagccacagccgctgctgctgctgcagccacaaccacagccacagcagatccagctccagacacagcctttgagagtcctgcagcagccagtgtttttggcaacaggcgctgttcagatagtgcagccacatccaggtgtgcaagcagggagccagttggtaggtcagaggaagggaggcaagccaacccctccagctccctg

SEQ ID NO: 3302 - DNA, 2663 bp, human
tggatcgagatttagaacaggctctggatcgcgcagagaatatcattgaaattgcccaacagagacctcctagaaggagatactcacctagggcgggaaaaactctgcaggaaaaactttatgacatttatgttgaagaatgtggaaaagagcctgaggatcctcaggaattgagaagcaatgtaaacttgttagaaaagcttgttaggagagagtccttgccatgtttactggtcaatctatacccaggcaatcaggggtattctgtgatgctccagagagaagatgggtcctttgcagagaccattcggctgccttatgaagaaagggcattgctggactacttggatgcagaagaattaccccctgctttgggtgatgtcctggataaagcttcggttaacatttttcatagtgggtgtgtcatagtagaagttcgtgactacaggcagtccagtaatatgcaacctcctggttaccaaagcaggcatattcttctacgtccaacgatgcagactttagcccatgatgtgaagatgatgacaagagatggccagaaatggagccaggaagacaagcttcagcttgagagccagctgatcttagcgacagctgaaccactgtgtcttgatccttctgtagcagttgcctgcactgcaaacaggctgctgtacaacaagcaaaagatgaataccgacccgatgaaacggtgcctccagaggtattcgtggccctctgtaaagccacagcaggagcagtctgactgtccacctcctcctgagctgagagtgtcgacttctggccaaaaagaagaaagaaaagtaggtcagccttgtgagctgaacattgctaaagcaggaagttgtgtagacacgtggaaaggcagaccctgtgatttggccgtgccttcagaagtggatgtggagaaacttgctaaagggtatcagtccgtcacagctgctgacccacagctcccagtctggccagcccaggaggtagaagacccttttggatttgcgttggaagctggctgtcaggcctgggacaccaagccaagcatcatgcagtcgtttaatgatccgcttctctgtggtaaaatacggccacgtaaaaaagccaggcagaagagccagaagtctccctggcagcccttcccagatgaccattcagcttgtctcaggcctgggtcagagactgatgctgggagggcagtgagtcaggcccaggaatcggtgcagagcaaagtcaaaggtccaggcaagatgtcacacagctccagtggcccagccagtgtcagtcagctctcttcatggaaaacaccagaacagcctgatcctgtgtgggtccagtcttcagtatcggggaagggagagaaacatccacctccccgcacccaacttccctcaagctcaggaaagatttcctcaggtaacagttttcccccacaacaggcaggcagccctcttaagcgtccattttctgctgctgctgctattgctgctgctgctgctgctgctgctgctgctgctgctgctgctgctgctgctgctcctgctcctgctctagctgctgctgctgctcctgctctagctgctgctgctgctcctgctctagctgctgctgctgctcctgctcctgctcctgccgctgctcctgctgtagctgctgctcctgctgctgctgcttctgcggcaccaagtcattctcagaagccctctgtgcctctcattcaagctagcaggccctgtccagctgcccagccccccaccaaattcataaaaatagcgccagccattcagttgaggacaggctccactggcctaaaggccatcaatgtggagggcccagtccagggagcccaggctttggggagcagtttcaagcctgtgcaggcccctggctcgggtgcccccgctcctgcaggaatcagtggcagtgaccttcagtcctcaggaggtccactaccagatgcaaggcccggtgcagtgcaggcatcttctccagcaccccttcagtttttcctaaatactccggaaggtctcaggcctctgacactcctccaggttccgcagggctcggcggttctgaccggcccgcagcagcagtcccatcagctggtttccctgcagcagctccagcagcccacagctgctcatcctcctcagccagggccacagggttccgcactaggtttgagcacgcaagggcaggccttccctgctcagcaacttcttaaggtgaaccccactagagccagaagtggtctgcagccccagccccagcctgctgtgttgagtctgcttggctctgcccaggttcctcagcagggtgtccagctcccctctgtcttgaggcagcagcagccacagccacagccgccgaagctgcaactgcaaccgcagtggcagccaaagccacggcaggagcagccacagtcgcagcagcagcagccgcagcatatccagctccagactcagcagttgagagtcttgcagcagccgcagcatatccagctccagactcagcagttgagagtcctgcagcagccagtgtttttggcaacaggcgctgttcagatagtgcagccacatccaggtgtgcaagtagggagccagttggtagatcagaggaaggaaggcaagccaacccctccagcgccctga

SEQ ID NO: 3303 - DNA, 2617 bp, human
tggatcgagatttagaacaggctctggatcgcgcagagaatatcattgaaattgcccaacagagacctcctagaaggagatactcacctagggcgggaaaaactctgcaggaaaaactttatgacatttatgttgaagaatgtggaaaagagcctgaggatcctcaggaattgagaagcaatgtaaacttgttagaaaagcttgttaggagagagtccttgccatgtttactggtcaatctatacccaggcaatcaggggtattctgtgatgctccagagagaagatgggtcctttgcagagaccattcggctgccttatgaagaaagggcattgctggactacttggatgcagaagaattaccccctgctttgggtgatgtcctggataaagcttcggttaacatttttcatagtgggtgtgtcatagtagaagttcgtgactacaggcagtccagtaatatgcaacctcctggttaccaaagcaggcatattcttctacgtccaacgatgcagactttagcccatgatgtgaagatgatgacaagagatggccagaaatggagccaggaagacaagcttcagcttgagagccagctgatcttagcgacagctgaaccactgtgtcttgatccttctgtagcagttgcctgcactgcaaacaggctgctgtacaacaagcaaaagatgaataccgacccgatgaaacggtgcctccagaggtattcgtggccctctgtaaagccacagcaggagcagtctgactgtccacctcctcctgagctgagagtgtcgacttctggccaaaaagaagaaagaaaagtaggtcagccttgtgagctgaacattgctaaagcaggaagttgtgtagacacgtggaaaggcagaccctgtgatttggccgtgccttcagaagtggatgtggagaaacttgctaaagggtatcagtccgtcacagctgctgacccacagctcccagtctggccagcccaggaggtagaagacccttttggatttgcgttggaagctggctgtcaggcctgggacaccaagccaagcatcatgcagtcgtttaatgatccgcttctctgtggtaaaatacggccacgtaaaaaagccaggcagaagagccagaagtctccctggcagcccttcccagatgaccattcagcttgtctcaggcctgggtcagagactgatgctgggagggcagtgagtcaggcccaggaatcggtgcagagcaaagtcaaaggtccaggcaagatgtcacacagctccagtggcccagccagtgtcagtcagctctcttcatggaaaacaccagaacagcctgatcctgtgtgggtccagtcttcagtatcggggaagggagagaaacatccacctccccgcacccaacttccctcaagctcaggaaagatttcctcaggtaacagttttcccccacaacaggcaggcagccctcttaagcgtccattttctgctgctgctgctattgctgctgctgctgctgctgctgctgctgctgctgctgctgctgctgctgctgctcctgctcctgctctagctgctgctgctgctcctgctctagctgctgctgctgctcctgctctagctgctgctgctgctcctgctcctgctcctgccgctgctcctgctgtagctgctgctcctgctgctgctgcttctgcggcaccaagtcattctcagaagccctctgtgcctctcattcaagctagcaggccctgtccagctgcccagccccccaccaaattcataaaaatagcgccagccattcagttgaggacaggctccactggcctaaaggccatcaatgtggagggcccagtccagggagcccaggctttggggagcagtttcaagcctgtgcaggcccctggctcgggtgcccccgctcctgcaggaatcagtggcagtgaccttcagtcctcaggaggtccactaccagatgcaaggcccggtgcagtgcaggcatcttctccagcaccccttcagtttttcctaaatactccggaaggtctcaggcctctgacactcctccaggttccgcagggctcggcggttctgaccggcccgcagcagcagtcccatcagctggtttccctgcagcagctccagcagcccacagctgctcatcctcctcagccagggccacagggttccgcactaggtttgagcacgcaagggcaggccttccctgctcagcaacttcttaaggtgaaccccactagagccagaagtggtctgcagccccagccccagcctgctgtgttgagtctgcttggctctgcccaggttcctcagcagggtgtccagctcccctctgtcttgaggcagcagcagccacagccacagccgccgaagctgcaactgcaaccgcagtggcagccaaagccacggcaggagcagccacagtcgcagcagcagcagccgcagcatatccagctccagactcagcagttgagagtcttgcagcagccgcagcatatccagctccagactcagcagttgagagtcctgcagcagccagtgtttttggcaacaggcgctgttcagatagtgcagccacatccaggtgtgcaagtagggagccagtt

SEQ ID NO: 3304 - DNA, 74381 bp, human
tgcggctgttccggtggctgctgaagcagccggtgcccaagcagatcgagcgctactcgcgcttttcgccgtcgccgctctccatcaaacaattcctggacttcggtgagtacggggccaagggtccccatgggcccggggccgccgccattcgggctgccaccccggatctccgcagcttcggggtaaagtctgtgggaaccgcaggcggggctagggaatatccggggggctctcctggggctcggatttcggggcgcggaggggcagggcctggccccctcgcacccagcctgggacttacccggagacacagaaacggcgtctcattgcaggaccctcatcgcaggcgagactccccaaacctgcggtcgttagcttcaaatctgcttgacacaaacctcacagcccttaaaacttcagaacgagatgtgggtggctttttaatgtttttatttttagaattttttttttttggttgggtaagaactgtttagaaataccttgaggttgaataaattatgcaatggcattttgttccttttctgctctaaggtgttgctgtgtggctggagtggcaggactcgaactgttgtcttcatcaggttatgttaaatcagttagaggcctggcctgcagacgccttagatgcttgggaagagcggacgtctgggatcctagcatcagagcagggtctaatacaactctggctttagtgccagcacctttcgtttctcttctccattggtgtcccacccacattctccctgtccggtgggctggtgggcggctttcacggattgaggtgggaccaaagaagattcgggttcccagcctgcctcaggcctagctgagatgggaatagattccaccaccttctgttaactgaatcatgtttccccagaaaacgaaggagctggttgtgaaacacctaaaagtaaaacgcatgcattgaggtatcagaatggaactcagcatccctggaggaaaatcaaatccagcagcaaagatgttctaagctctccaggggaaatcgtagggtgtctgttcatttaatgaattttatgtaaatgtcaagggtgtcagtgatagtgtcagttgggcataaaaactaaagtgcagagtaggtagaacatttgaggaagacctgatatgcaaaaagtgatgtccatacttttttttttttaaaagctaggataggaagagaggaataggttaaagttgagaccaaattaaaattttagaagccaatttgccagagaatgatgatgaaagtcaaagttcaatgacacgttgatttctgcatcttcaaacttcactcccaaaagctattggtagttttacttactatctcgagaattgtagaggtttgaggcagtttctgactttagagtttagaaaatgttgctattgctataaatataggcaagttttccatctttatggtttagggaagattctgaaggtatcagcctttcattagtgtaaactgaaacaggataattcacaataaaaggaacaaaaggaatccagaaactcccagttctttccaccctcaaagtttaagtgatagctccaatagccagccaaaattttggttagttgatttccatagcagctagtgtctacccgtgttaataggtattttggtaaggatgttatgtgagtaggaaaaccacagtggaggatagtgttatcatggaaaacctgtgaggccagtatctggaaacaaatgttctaattctggctctgccactagctcagaatgtggccttgactaagtgaccaaacctcacttggggttcattttcctcattaataaaatgagtagattgtatcaggcgatctttaaaagcacagctcaccactatacgattgtgatttcaaaggaagaggcatgaactttctaaaagaaaactaccaaatcttttgatagatatttcctataaaagtcttctgacctattttgggaggggtggagggattcactaaggtcatgagagaagcataataatttaaggttttccttataaggaagcgcacagaagtgctagatatagttgtagtggaatttgctagaagtgacaaggctagtttgtaacacccagagatgaatcaggtgctaatcagcctatctttaatgacaggacaactaaaagacgggagttgttgcaaaaaggccatctctacttctacttttctcttagttctgtctcttgatagcagttctattttggcaattgatgtgggagttggagaattcagaatgggtgtgggatatttttaaggtgaggagagaggaggagtgaagaggcttcatgcccctgtatgattagagaaaactgcaggagagggccaactcaggcacttaaagcaccaggtagtgggcagtggataagtgaatgaagccaacgagttgaggaccgtgataaattcctggtatatagctagctccaaaggggcagctgattggcaccaattcagtatatttcaagagaactttggcataaacaaaatagatggatggatcaagttggcccacaggctgctagtttatgaacttgatgcctttctccatgggtactttacaaatgggacgtacattttgactagagtaactagacagggaccagagaaaggagatacacaggatatacacaatttgttacaaccttgataaataggctttcttatgtggatgtactgcacatcagtaaataaggagattatttgctatgttcaaaagtggaggctaaaacttgttgttacttcagaagctgtgcttttattttaaagcaggggttcctgagcctcagcactcttgccatttcaggccaggtaattttggtaggagctgtcttgtgcactgtgggaagttgagctacatccctggcctctacccactagatgccatgagcacctcccactccaagtcgtgacaaccaaacatgtctccagtcattgccaaatgtcccctgggggagcaaaatgtcccctggacttctgttgaatcactgtttggaagtgtttacttgagtggttttcaggccagggcctcatactctgaatttttgttgtaaatggtctgggggtgctgggggtggagagcagagcactggtatttttaggagatccccctgtcattctaaagcatatccagggttaagcaccattaatcagatgatcttctgtctgatctgctggccccctttcatctatgtgcagtatttttctctatgctttttaaaataatgaaagtttcttgaactccatcttgacttgaaatatagcctgccacacagttagcaaatatagcaagaataacaagtgttctaaatggatttttaatttattatggcaatagtacattccaaagggtggcattttttaaaatgagatttttcttttgggcctaagattacagtcacatggttccaaattcagagggttcaaaaggacacagaaaagcctgcttcccacttgtgcccactggcctccccttttttcgcataaatggcagtttatagctttgtctgttccttgttttttgagcttaataccttagagacagatttttgtatatctgtacctgcagaactttgtttttcttttttatggcttctgagaatttggttatatgaatgtaccagaatttattagcaactttccctattgatggctacaattaataggttgtttctagactttgctgtggcaacctgccctccagtgaattattatatgcattgtcatttcatgcatgtccgcgtgtatctgtaggacagattcctaaacgtgagattgctacatcagcaggtatgtgcatttgtaattttggcgaacattgtcaaattgctttccataaaggttgtttgttttccccctcgctagaagtttctgagagtacctgttttcctatgccttcaccacattgttgtcaaacttttgataggtaaaaaaaaaatgatatatctagatagaatttttttctccttgagtaaagatgtctttattttagttttttattgtggaaattaaaaaaaaaaacttaggtgggtgcctgtaattccagtgctttgagaggccaagacagaggatggcttgagaccaggagtttgaggccagccctgggcaacatagtgagatcctgtctctaaaaaaaataataataataaataaataagattagccaggagtggtggtatcgcacacctggggtcttagctactcaggaggctgagacaggaggatggcttgagcccagattgaagctgcagtgagctgtgtttctgccactgcactccagcctgggggatgtacatgtataggtaaatacatatataaattttattgtgtataattaaggtatacaacatgatgttatgggatacatatagttaaaaggttactacagtgaaattaacatatctatcatctcacatagttacccttttttatttttgtggcaaggtcagctaaaatctactcatttagcatgaatcccatatacagtacaattttattatctattatatattcttcatgttgtgcattagatctctagaccttaaacatttacagaagtagagagaatagaatgatgaactcctgggtttgttttattgatatccatttgctatttgtctgtagatgttgtatgtgtggtctgttagattttctgatcaaagtcatgcttgtttcaaaaagataaatttttgttttcaaaaagataaatttttttcttttcctatgctaagactaatttatcttttgaattatctggttcttaaagatttggtagaacttcatatgaaagtgtttaagcctgtatgttttggggagttttgctctctgatagctttctctattctgtgttattgatctctgtagattttctgtctcttctagagtccattttgatatatttttcttgaaaattatcctacttggctaggcgcggtggctcatgcctgtaatcccagcactttgggaggccaaggcaggtggatcacatggggttgggagtttgagaccagcctggccaacatggtgaaacctcgtctctactaaaaatacaaacattagctgggcatagtggtgggtgcctgtaatcccagctactggggaggctgaggtaggagaattgcttgaacccaggaggcggaggttgcagtgagccaagatcatgcccttgtactccagcctgggtgacaagagtgaaacggcatctcaaaaaaaaaaaaaaaaaaaaaaagaagaaaagaaaaaaagaaaattatcctactcattgaggtttttaagtcagtttggatagctgagatagttgtcactgaacagtcttaattttccctgtgacatttgtccccccccttcttcttgagtaggttagttgatgatttattgggttggatttattagttttatgacttttgttatctagtttattgtctgatttgactttaataattccttctggtctcaggtttattttgttcttttaaaaattaggtgctttctgttctcactcataagtgggagttgaacaatgagaacacatggacacggcaaggggaacatcacacaccagggcctgtcgggaggtgggggggctaggggagagatagcattaggagaaatacctaatgtagatgacaagttgatgggtgcagcaaaccaccatggcacgtgtatacctatgtaacaaacctgcacgttctgcacatgtaccccagaacttaaagtataataaaaaaaattaaatgctttcttctttgtcttgtttatttcaatgtttaaggttagttattcctctgagcactgctttagcagctgatgtgtgtatttggtcttttttctcttagctcttctgtgtcttcaggtttttattttcctatgaatgaagagttgtttggaggagttaaaaatttccagtgaaggtgcattctgcattttaattttatttatgtctagttttgttgcactgtgattacagaatgttgtctgaattattctctaatttattgatgttaactttgaagctcattatatggttgttttctgtgaatgttccttgggcagcgaaaagaaggttatactctcttctcaggttgcagagtgtgatatgtcagctctgcaatattatgttatttaggttttgtgtaactttactttttttatccacctgatttgtcatggatcaaacacaagagaagttaaagtctcctaataatgattctctttctccgtatagctcctattgtttttgctttatgactatcagtgttatgtttgatgcttattaactcacatcctcattgtgagatatacccattagcattagagtgctgcccttttactagttgaaggctttttggcctggattcgtccttatttgacattgagatctagttccctattttcttgtttacatttcctgggatagcattgccatccttttattttcagtttttctgaattacttcgctctaaatatgtctctaaatgtagtgtaaagttgggttttgctttgtgaatcagtctttttcatgtggtaagtttaacctatttatacttactggtatgatagatctgtcatctgtaatgataagcatttgtaattttctgttgctttctgtttttaatacctcagttttcctatgttatatatttgctttgttttgccatatttattttaataaataactaggcttgaatttttggttctagtggttatctttatagttattactttatttctatagacctttgtcccatatgggtcaccacttgtcagccaggagacctttgagcacttgaaatgtggctagtgtggccgaaaaactgaattgacttaatttaaatttaaaatggatacttgatgcagttaatttttacatctgtgtagaataacttggatatggaatccactttatcacctgtaaattttaggaaatctctttataggtcaattatttctgatagaaatttagcctctgaattgagatgtgctttcagtataaaatacacactggatttcaaagacttaatataaaaatagtaaaatatcagtacatcttatattgattgcatgttgaaatggtaatattttagatatgttgggttaaatggaatattatcaaaaactttatttcttttttatgttaatgtggctactaggaaattttaaattatatatatggcttacatatttctttctttcttttttttttttttttttttttttttgtgagacggagtttttgctcatgttgcccaggctggagtgcaatggtgcgatctgggctcaccgcaacctccgcctcccaggttcaagtgattctcctgcctcagcctcccaagtagctgggattacaggcatgcgcctacatgcccagctaattttgtatttttagtagagatggggtttctccatgttggtcaggctggtcttgaactctcgacctcaggtgatctgcccacctcagcctcccaaagtgctaggattacaggcatgagccacagcccctggcctggctcacatatttatattggacagtgtggcttcagataatatatgttaattccttattgggagcaatgaaaacatcacattttaatgttcagaataaacatttattggctgggtgcagtggctcacgcctgtaatcccagcactttgggaggccgaggtgggtggatcacgaggtcaagagattgagaccatcctggccaacgtggtgaaaccccgtctctactaaaaatacaaaaattagccaggcatggtggtgggcgcctatagtcccaggtactcgggaggctgaggcaggagaattacttgaacctgggaggtggaggttgcagtgggccaagattgcgccactgcactccagcctggctagagtgagactccgtctcaaaaaacaaaacaaacaaacaaacaaaaacaaaaaaaccaaccacacatttgttgaatttatttatttatttatttacttatttgagacagagtctcactctgtcacctaggccagagtgcaacggcttggtcttggctcactgcaacctctgcctcccgggttcaggtgattctcctgcctcagcctcccgagtagctgggattacaggtgtctgccaccacgcctggcttatttttgtatttttagtagagacggggttttgccctattgcccaggctggtctcgaactcctgaccttaggtgatctacccgcctctgcctcccaaagtgctgggattacaggcatgagtcaccgtgcctggcctgaatttatttcctgaaatataactttcacatgtcttgttccatatttttttctataaacctctctggatttttggatcaatgtattgtttttgactggcagttaatgttatggtggctccttgttatatttgcacaaatttgagttctctttcccttaagcagttgtgataaattaaaaattctcttaattatataagaaaaggagaacttggactattatggcataaagatagaaccttctgaatgttgaatgagttggtaggaaatgattcacattttcttttggacttgcttttcatctttcagtctcgccctgtcggcttctggttcccatattaaccacttttctcccctccctgcagactgacgtcccatttgtttgattttccagttacttttgcacagccacacttgcattaaagagattttgctcctgcctccttttcttagattttatcctcaattgtctctttccaaagggcaggcgctcacctcttttttgtaacctcttacagcttcctcagctcagcttgctctgcacagagcaggtgctccataaatggcaattactgatggcatgcctgactccatatcgaggttattaaacattatgccactttcatttagtcagttatataagtttattttatttatttatttatttatttatttatttatttatttatttattttgagacggagtctcactctgtcgcccaggctagagtgcagtggcaccatctcggctcactgcaacctccgcctcccaggttcaagcagttctcgtgcctcagcctcccgagtacctgggactacaggcatgcgccaccacgcccggctaatttttgtatttttagcagagacggggtttcaccgtcttggccaggctggtctcgaactcctgacttcaggtgatccacccgcctctgcctcccaaagtgttgggattacagacgtgagccactgtgcccagccaagtttaaacttccatagtgtccccatgtgtaaatatagcatctctcaaaaccaccagaaagcagattgctgatagccctgccgtcttttcacaaaactaaatattttgatttctgtcataatcacaccggctctgtgaacctcagagcctttagctcttagaaggtagcggccagtttccgcattcttactattcttaaagtttaagggcccagccatcttcttttcctttagaacatattttaagatactttggagatactttggttccaaatgactccctttcgcaaagtcttggctttttaagtcattttgctccttgaagcctgatcaccactggggacaacagtgattgcgttcttggagaaaatggaaaggtttttaaaaaaattatgttaggaaaagggaaaaacaatctcattctgcttccgagtgtgtttattttgtacctttacatatgtaaatgacagattttttttttttttccctgtaagcagtagtttttctgctacaaggtgtcaccaagaattagaccaacctgtttggagaaagggatcaactattcagaattaaaggggaagagaaaaatttagttgagggtaaagatatctaacttggcttattgcatcttgaccagtttttaaatttaaagaaagaattggtccaggcactgtggctaatgcctgtaatcccagcattttgagaggctgaggcaggaggatcgcttgagtccaggagtttgagaccagctcgggcaacacagtgagacccctgtctctacaaaaaaataaaaaaattatccaggcatagtggtgcacccctgtggtcccggctacatgggaagctgagatgggaggatcgcttgagcctgggaagttgaggctgcagtgagctgggatcgcgtcactgcactccagcctggacaatagagcaagaccatgtctcaaaaaaagaaggagggagggaagtagaaagggaaggaaagaagggaggaaaggtagaagacggaaggaggaaaggaaggaaagaagggaggaagtgagggctttttgggcctttaagatctgataaggctgcattttaacatggcgtggtttatctggctctggggcagctctcaggcaccaaagtcatggctttggcctcactgtctttgtagcacttatgttttgtgtgcttttgaaagtggagacagctgcagttactgatctattgatggttgggtggtttcctcccattaagcttttggaaaattgatcagactgttggcaaggtttgggaaaccttggttttgttactggatggaatctgaaaatatcactgctttttcttttcctgtatatgtataggcattccattattttacttccatggtaatctgattttagagttgggcaaatccttttattttaggaataccctggtctaagaatgtcaacctatagcctgagggctggccacctgtttttttttttctaattaatagactgttttttaaaaagagtacagttcgtcctccatatctgtgggttccacatccatggattcaatcaacctcagatagaaaatattcagaaaaaaaattccacaaatttccaaaaagcaaaatttgaatttgcctcaccttgaacactatgttgaatccatgtaaatgaaatgatgtgtaggccttgtaactagtctagagataatttaaagtatatggaaggatgtgcataggtcatatgcaaatactctaggccattttatgtaagagactcgagtatccatggattttgatatccaagggtgtccaggaaccaatcccccacagatactgagaggcagttttaggtttacagcaaaattgagcggaagtacagagtgcccacagaacccctccccacccccaaacacagtctctgccgccatcagtatcctgcaccagtgtgggacatttgttataattgatgaaccagcattgacccatcattatcacctaaagtccatagtttacattagggctcattctttgtgttgcacactgcgggttttgacaactcctgtttttgtaaataaagttttactggaacacagccatgctcattcatcacatattgtttgtggcttttgtccatccacaacagcagaaattgagtattgacagagactatatggcccacaaagccaaaaatgtttactatctggtcccgtacagaaagtttcttgttccctgttctaagacaaatcagttccctctttaaagaactgagcagtgattggtcttaatttccatttaagtggtaaagctctgtttctcctgtatgctagtaacaataaactttgactatctggagtgtgacttttggggtagtgaaggcttttccaggtaatcgggtggtttacctataggatatctgcctcagagtggaattaccatatgaaagctgttgacagtttataggtttaatttatccagggctgtcagcaaagtttatctgtatcagtttctccgtagccctgccaaaatgaggttttatgattttaatcgcatcataggtaacataggaatgaaaagtgctttttcctctgcttgggttttttgtctgctttttgttctgtgtaaagtgccattggccattttgtaaccagaatctgaagtttttatcatttgcataaattcctgtgtatatttggcatagtaagctcttgtgctgtgtaaatatcgtttcctttggcaaagtaattatcaaagtataaaactgaagacatttggaaagaattgctatattacctgtaatatgggtaattcatctgtttttttgtgatagcccttcctgcttttgcccatatatttacatgtgttaacactgtatgttggtttcctttttatctagtgcacagtctgagttttcatatgctcagtgttacctatatcatttacggtgcttttatcatggtcagatttgtcacctatagcagagtttgtaagtagttattaaatctctctggaatctattgccattttctgatgagcctttgtagctaactcatttttaccctgttctgctgtcaagttgcccaacaattattaagacctcaagtttttctcttgaaacttggctgtttctcttttatcttggccgtttctctttgatcatatgctaagctctcagagtagtttgtatttgtggattctagtcaacatggcaacttttctgattttaactaaatatcacattttaactttgtaatttatgttgaaatttggtgagggcagttccttatttattactttacattttaaataattcttgcttttcttgtgtactaattcttcttgataaattagtcattgtgcaccttgaatagcatatcatcaaaagtgtgctaagggaactgtggatgggttacgtggtgttttagggtttacatctttgccatgtacttggcattgaaactggcattgaggccgggcatggtggctcatgcctgtaatctcagcactttgggaggacaaggtgggtgaatcacttgaggtcaggagttcgagaccagcctggccaacatggtgaaaccccatatctactaaaaaaaaatacaatacaatacaaaaaatcagctgggagtggtggctcatatctgtagtcccagctactcaggaggctgaggcaggagaatcgtttgaacctgggaggtggaggttgcagtgagccgagatcgtgccactgcactccagcctgggtgatagaatgagactctgtcacaaacaaacaaacaaaggaaaaactagcactgaagtatcttcagttagcctatttcgcttttatggcaggaaggctagtttacgctatacttgccttcgtgggagagctgggtttgattgtgacccatggtggatgtccttcatatccctcaaggagaaccccattcctggtcattgcctcatcttaactctgagattaaaccttttgccataatgaatggcagaaaaattgtagtaaactattacatttgcacaggtcagcatttatattcgctctaattgaatacttagggttctaactcagtggtatgttatttccctaagggtcacctaaacagttgtgattttattttcattcttggacttgatctatgattctccttaaccatttgagttgtaccagtgttgctttctctcttaccagggcatggaggtcagtatataatagtctcactgttgggaagaaattatcatctctctaacattttcccataccatgaagttaaatattttgccatgtgttgctggccagaaaacagtagggccttttgaaatttgtaacttacatatattttcccacaattgttacattttcatagaccagagaacactcaggcttctatctgaaccttttcttggatctgtcctagtagggtataatgtttccttaagcttgctagcagatatttcttaataccagcctgtggattttgtataactttggttaatttctcctcctgattctgctgttaaatagaaagcaaagtggttattgctgtattactgttcctgcattggtcatgtgatgtgctcatgtgagcactttatttgtaatagactcttctgggaggaagctgcttgtctcagggagtctcctgttctctagaaattgcccttcatggccagggtactgcttcttttgttagagctccttacatattctctaccgtgttatctctggcctacatactcctattcctgtttctttgacctgagcttgacttcagtgaagctattggagaaggaaattaaaatggactcttggctgggcacagtgactcacacctataatcccaacactttgggaggccgaggcaggcagatcacctgagatcagcagtttgagaccagtctggcaaacatggtgaaaccccatctctaataaaatacaaaaaaaaattagccaggcggtggcacgtgcctgtaatcccagcaacttaggaggctgaggcaggagaatcgcttgaaccagggaggcagaggttgcagtgaaccgaggtcgcgccactgcactccagcttgggcgatggagtgagactccgtctcaaaaaaaacaaacaaaaaaaaaaggactttatatggcacctgaaaaagattcaatagattcgactagcacttactgagtacttaccaactaaaacaggatatcatctaattctcacaacagccatgcccattttaccaattaggaaactgaagttctgagcgggtaagaagatgactcacacgtataataggtagtagagccacatgtctgcccgcctgatcgtcttaccacctctttatagcagagaaagtaggtgagggattgggcgcagtgtgtgagcaaaacaaactggaggaaaggaccatcgagtgcattgtcaccgcctcccaagcattaccacatcctgaagcacagccgtttccttctcgagtttgtttagtttttatcttccccatttaagatcatctgaaagtgaaagggaaaaaaagagctgacactgaaaagtctcttacagagtacaaagatgtttgtgatcagtttcccaagaggctgaaataaaactcaaaggtgaaaataaagacaacagtacatgggtaaataaaaaattggggatgcttaatagccattgtctgggcttgaggagttctttgatttgtttaccctcattgaattttctatgattagatgctagtccatggttctcagtcctggctgctcatgagaattgtctggggagcgcctgaaatgagtgacacctgctccctacataaaccaattaaatcaattgctgcgggtaggagtctaggtgctggtgcttttgggttacccaggcgattgtgtaataatattcttccagagttaaaaccacagtgttagagctggtgaaatttttgcccaagagctatgaaccactttaggggatagagtctgtgagtgagatgccaaaggttaacaccgaagtcattctggagtccatcagcattagttgaaagttctggatttggaatgaaatggaaactaagaagcattgggaaattgccaaggcatattcattgcctttgaggagctcatagataaatgagaagctgggacaaatacataaatttacgtatgctagtcagaaggatgaatcatataattttgtggtatctttttgctgctgtccctacctcgcccttaaaggtttttgaaataagggtggtttctgggaacaggtaaggtgttaacccaattgtcctttatccaaaatgttgttggaggctttctggatggagatcacaaagagaagaacaaaatgtaaatgtgcatactctttttctttttcttttttttttttttgacaaagtcttgctctgtcgcccaggctggagtggagtggcgcgatcttggctcactgcaagctccgccttccgggttcacgccattctcctgcctcagcctccccagtagctgggactgcaggcgcccgccactgcacgcggctaattttttgtatttttagtagagacagggtttcaccgtggtctcgatctcctgacctcgtgatctgcccgcctcggcctcccaaagtgctgggattacaggcgtgagccaccgcgcctggcccctttttcttgacttccaccttttttccttggctgtttactcctagcactgctctccagagttttcttagaatttatattagtaggcaaggttagtgtatgataaataactgtatagagagacaaacaaaaatcttatcctcttagactaattcagtgggaacttgagcttagagactgatgtggtttggctctgtgtctccacccaaatctcatgttgagttatgattttcagtgttggtggtggggcctggtgggaggtgattggatcatgggggcagatttcccccttgctgttctcatgatagcgagtgagttctcatgagatctggttgtttaaaagtgtgtagcacttctccctttgctctctctctctcctgccaccatgtgaagatgtgcttgcttccccttcgcctctgccatgattgtaagtttcctgaggcctccctatccatgtggactgtgagtcaattaaacctctttccttcataagttactcagtctcaggtagttctttctagccacatgagaacaaactaatacagagatcatctgtaatcttcccaattttacacatgagaaagtagaagccccaagtaaggaagagactatgccagtcatcagctagtttttggtataacatcttggccacctcttccaaagggaaccagaaattattctttttatgaggccaagggaacttacatttgtgtgccactctctgctaaacacaatagtggttagctgtaattctcacagcgtccacattaagtgtttccatttcttggatgaagagtctaaagcttagatagtttaagtctcttacctaagcaaagttaggggcaaagccatggttaaaattcaggtagagtgaggtttgtttgtttgtttattttttggagacagagtgttcctctgtcgtccaggctggagtgcgtggtgtgatcttggctcactgcaacctccacctccaggttcaagtgattctcctgccttagcctcccaagtatctgggataacaggcacccatcaccacgcctggctaattttttgtatttttagtagaaatggggtttcaccatgttgtccaagctggtctcgaactcctgacctcaagtaatctgcccgccttggcctctcaaagtgctgggattacaagcaagattgagcttttaaacctacgctcttttcagtttaacatagtataccattgtccccagtgcaattctttatagcaaatatagtctctattagcaatgctgaggttttgtctaaatttattctgttacacaatcaggaaatggtataatctaatgcttatctagttttattatttcagaactatcagattgatacctactccacttacttacaatgaaataattctacttctgaaaaccactacttgttagtctgcattatcatctctgggaatatgagaagcagtatatacagacttgtactccagtcttaatttctgatgcctaccagcagtgtgagcctgggcaaatcacttaatcccactacacttcagtgtccttatctacaaaatagaaatgctagtggctaatcataggatggttgcattgatgagattgagaacgtatggcatagtgcataacacatggtaggtgcttggtagatgttggttatgaatttactatgagaagttagtgacacagcatttccttgatgaagtcagctttctgctaagaataaaagctgggtagggagctcttaaccttgaatgttaattatcttcaagtttattggctgaaggtctcagctgtacaaaactgatcattttccaagaaacatagcactttcagctcttttgtgctttgagagtgacttgctttggattccctttgatcactgtgatggctaactaaatgatttgcctcagttaacctcaaatatgagtacagtgtgaccattagctattcctgcttccatgacaacagggcatcctgtaactcaccaatttaccgttaggactagattctaaactcccttctggaattaggttgatatggatgcatggcggctttggctgcatagtgcttgttactcacatgctctagctcgtcacagctttatttgtgacatctgttctgaacacatcatgtctcttccactctctggcctgacacaccatattgactgttactgccactgtattgtcttcctacctgccttttggctcttctcatgattttaaggattgaatacccttaaacaaatatatagaatgaagttggcctgtaagagggatttaccgttacctgcaaatgttatcttgaacctctgaattttatttgctatgttaagtttgtaactaaacttactgggtgttttaattttcagttgcgatccgaggtttttttgtgtgtgtgtatgtgacacaggctctcactctgtcacctaggctggagtgcagtggcgcaatcttggctctctgcagccttgacctcctgggctcaagcgatccttgcacctctcagcctccgagtacctgggactacaggtgcacactgccacatccggctaatttgtatattttttgtagagacggggtttcaccatatggcccaggctggtctcgaactcctgagctcaagtgatcctcccgccccggcctaccactgggattacaggtgtgagccaccgcacccagccaggaaattttttgttgttgttgaggcaaagtctcactgtgtcgcccaggctggagtgcagtggcacgatctcggctcactgcaacctccacctcccaggttcaagcgattttcatgcctcagcctcccaagtagctgggactacaggcacgtgccaccatagctggctaatttgtttgtatttttagtagagatggggtttcgccatgttgcccaggctgatctcgaacatctgagctcaagtgatcctcccaccttggcttcccactgggattacaggtgtgagccaccatgcccagccaggaaatatttattgaatacctacaatgtaccaggtattgtactaatggactcttcaatcttttgaggaatcatgatacaggacatagaactcatagaactcagtgactgaggcagtggcagagggcattgcccaagcacagggcacaacttctgggcccacagagaaatccattcacagcttgctttggctttgttatacagagcagcagttttctcactagtctgtgcagatatatgtttcaaaagagcaaacaaacaggatttctaaagagaggggatcaagggactactaccttaattaagaactctatcccaatcaccttcgtacccccttttcctatcagaagaacaaaaatcattacatgaagggtaccacgggtgtcagaccccattaggaagctctgcatatagtagcatattttgtatgagatttttgtatttttttaaagaatagaatagttctagttataggaagatttttatgagttactttgccgtatttgctttatttttccctctccatccatccctattcctctctctctctctctctctcacatacacatgctttatgcttttttgctgaaccatttgagaataaattgcagacatcatgcctctttacccctagatacttaagtatgtatgtcctcagcttaagggtattctcctaataaccatgatacagttattacccttggggaatttatcattgatataaaaataaaatggaacatctaaatttcccttaatggggccaggcgctatggctcacacctgtaatcccagcactttgagaggctcaggctggtggatcacctgaggtcagcagttcgagaccagcctggccaacatggtgaaaccctgtgtctactaaaaatacaaaaattagccaggcgcggtggtgcacatctgtaatcccagctactcgggaggctgaaataggagaatctcttgaacctgggaggcggaggttgcagtgagctgggatcgtgcctctgcactccagcctgggcgacagagcaagactccatctcaaaaaagtaaaacaaaaaaataaataaataaatttcttgtaatggctgccagttcctatattggacagttctcaggtctagaacactctcagaaggcactgtagcagaggagggtgctgagcatagtgcagcagagcccggggtggggggataggggactcctacctcagcaacgcagcagaccagtagcgggcaggagtggcaggaaggctggctgggtgccaacaggagaatgaactaaaagtctgcagacagaagggccaccctctgttctgacctctagaacattaacagcaggcagttatccctatcggcaaggtaaaggacaaaagggggttcttctctaaagacactgatggaactatttcaggagaatcagggaagctggtgtggtattagcgcccactgaaaagccccagtgtaatcaggaattcagggagctctctccgccaagagccccacagggctcccagtctttagcctgcttccttcccaaacctgactgaacaaccaaagatcaccacacgtctgagggaagcctacagcgagaaagagactaacaaagacagaaaaatggacattaacccccaaaagagacaaaatctgactggccataaaagagtgctttaaaatataatttagcaataaatcatctacaaccccccattaacatcccagagaagatcgcattttccaaagatggccatgaggatacttttctacagtgtgaccttggcacccctctgtcaggagcaggagtcgaaatttccttctggagtctgggcaggccctggctacttagcctaattgattgtggcagactaggccagctgtgtgacttctgagcctgggtcataaaaggccatgcggctgctgtcttttcactgaagtggtggaaggatccaactagcccgaagctgccgtgatgtgagggagcccaggaagaggccaccccaagctgctcagatgggcagtcctagttgtgcagttgtctgtcccaagcatcagacttaggagtgaaggggccctcggatgtttccagacccaagatctagtcaccctgcagccttcgggttttcccagctgaagcccagataagccatcccttctgcgtgctgtctaaattcctgactcacagcatctgtgagtatcataatatggactttggactgaaagaagtcgtgtaatatctagatgttttggggcactgaatttgatagggaataaagtgtgcgtgaaatccccagtatttggctctttgtctctgaagttctgactcactctttttgtttttgtttttttgaaatggggtgtcactctgtcacctgggctggagtgcagtggcacaatcacagctcactgcagcctcgacctcctggctcaagcgatcctcctgcctcagtctcctaagtagctggaactatagtcacgcaccaccatgcccagatgattttttatttttttgtggagactgggtctccctatgttgcctgggctggtcttgaactcttggactcaagcagtcctcttgcctcagcctcccaaagtgctgggattacaggcataattggctcactgttattaataaccaaaacatggtctggcctagagtggaggcagccccaagtttggcagattccaaatctgcagcctattttgatccttcttaaattcagaaataaatgttcttgaacaaaggaaaactcttaagctcttaaggcagtgagaaactgctcatgaaacaaaacaaacattttaaaagtagaaactaagtttttaaaaaagtgattctttgaaggacattcacaaccatttggtaggtctccattcacatgtcagattgtttcttctgaaggactattcaattaatcattgtttaaccctagtaaatcaaaaaattaatgacttattctaaaattcagtgttttcaacagattgaaatcttataactacaactagagaaaagaagttgaagagctcacctgcacacatggacataaacatggggacaacagacactgtaaactactagacggagggggaagtgggcgcgggttgaaaaactacctattgggtactgtgcacactgcctaggtgcaacatacacatggaacaaacctgcgcatgtaccccctgtatctgaaataaaagttgaaaattttttttaaaaagcttaaaataatatgttctcagttatattttaccaatttaaacatggctaatgggaaaagtacattgccaactcagacatttagttggtgatattaatcgaaagcatttagttgatgatattaataaaaattatcagaatgagctggatcattctgttggggttttttggtgccttgcgggtaatttttccatgtattgctctttatctcattattgccactcccaaaccaccccccaacccccaccaactgctaaagctgaacaatggacaaagaaagccttcaagtaatccagacagaggagactctacattttaggaggcatggtctctgttgattgaagacagtacaaaatatgtcctcagcctctgctttaattaaaaggtacttactatcaatcacttgaacctaggaggcggaggtggcagtgagccaagattgtgccattgcactccagcctgggcaacaagagcaaaactccatctcaaaaaaaaaaaaaaaaaaaaaaaaaagacacttattatcaggtgacttgattaattgaagaaataattattttttctgccgcctgtaaattagtcgaaaagaggattaaaacgaagccagggttatcagccactatgtaaaccaggtataaagaaatatgtctgtgagctcctgctctcaggtggctagctaaacgctcttggctacctcctggtcccaccatagggaaggctccctgcattacattgaaagtcatttatatttctgtgtctattcaccctaggtcttggtgaatgtgaagctatatggaacctttctagacaaagcaaatcataccttttgcaaatatagtaattgtctccagcttcccaataaaaggacaaagtataaaaaacaaacagaggccaggcgcagtggctcacgcctgtaatcctagaactttgggaagctgaggcaggcggatcatctgaggtcaggagttcgagaccaacctggccaacatggtgaaaccccgtctctactaaaaatacaaaaattagccgggtgtggtggtgcatgcctgtaatcccagctactcaggaggctgaggcaggagaatcgcttgaactcaggaggtggaggttgccgccacttggtgagccaagattgcgccactgcactccagcctgggcaacagagagagactctgtctcaaaaacaaacaaacaaaccagaaacaaaggagaatgaaaggatcgtcaaacttaggagaaaaacagaagaaatgcacatgagtgtatttgagtctaatgacctgtttgcatccactaagtcagagttttccaagccccctcacctgctccctttgtcatctttgaactgataccagggaaaaacttaattggtaaatttgaataagatgaagtatattgagaaatgcagaataaaaatagaaagtcaaaattaaggaatgtagagaagccaagtaagtagggaaaaaatgaagtcaaataattggaaagcagaactggaaaatacacaatataccagaagacttatcaaaacagaaccctctggcgaggacattcatttaaaaccaaaatgtttttcttggtaagtttattatttaaaaaaaaatggttgttagaaccttttcatttaaactgagtatccggcattaatacataggaaagatactttcaatgtacgtgaagaaagcacagaaaggttataaaaatcaggcatttcatacttatttttaggctaactaattaactaaaaaagacttatcctcctatttaagctgatatataattaaggtgtctgagtacaaagaatttgtccctaaacctaatgtagaatgtaagagacaaaacctgaaattttccaactactctttttaaaaaatacgaacttctggactgagtgtggtggctcatgcctgtcatcccagcactttgggaggctgaggcgggcaggtcacttaaggtcaggagttggagaccagctagtccaacatggtgaaacctcatctctactaaaaatacaaaaattagctgggcgtggtgatgggcacctgtaatcccagctactcaggaggctgaggcaggagaatcgtttgaacccaggaggcgtaggttgcagtgagccgagatcacaccactgcacttcagcctgggcaacagagtgggactctgtctcaaaaaaaaaaaaaaaaaagaaaaaaaaagaaatcaacaacaaacaaagaaaaaaacaaacttctgaaagcattatctattatttgaaaaaatcattgagaagctaccataggcgaggcactataatatgtgctatgggggatagagagacagataaaagtttctttccacatgagttttataacaggctgataatccaaggaagcttgaagaaaatgcttcctgaaatttggttctcttagaccatgcctagtagttgagttttaactattgcagaatcatcagatgagcccagggaatgggttctcagggctgaccaagcagtaactgacagttcgattgtgtatcccatggcctcagactattctgtttgagcatcatcagcgtcattagtgattgctatttaattagcccctcttctaagttttaagaatatgtgactgttaaatattgtggtttattaagtttttatttatagagatgggggtcttgccacattgcccaggctggtctcgaactcctggcctcacatgatcttcccatctcagcctcccaagtagctaggattacgggcgtgagccactgcctctggtttaaatgttaagcacatgttaaccctcaccaaatctctgtgaagtagatactgctctttttttataggtggttacaatgaagtttagaagtgtaaagaaacttacccctgctcatgaagcttgtgaatgctctagtcaagattcaaaccctgacctttgtcatcgaacttcagcacctgacctttgtcatcaacgccccgcaggaccataagcttttctctgaatcctgaactcaaaaaactctgaaaattgaatttctttttcatatatttgctgccacaactcattttgtggcaaaaccagacctgaactgacttgattccatagtccttatcctacttactggaaatgttcacgtatttcactgcagctatgttgtggctctctaatactctgtattgtacaatgtatggtatagactcctttttaccttcctaaaattgaaaaacctttaaattctgaaaccatctagatctgcaacttctagagaagagatgagaagctgactatggccacctcacacctgccagccagctctcactgctcacaacatgctcgtatcctgtgactcctaacaggctgccaacttggaaatttaaacatgtatactttcattaccctcaaaaactcataattgtgaaaaaattattagttcatactgatactaccagtttcagtttaacaccagaattcttctacttcttccctattccagaacttcctttttcctcttaaagaaaaaaaaaaactggctagacatggttggtggctcacacctgtaatcccaacagtttgggaggccgaggtgggcggatcacctgaggtcaggagttcaagaccagcctggccaacatggtgaaaccctatctctttgtaaaaatacaaaaattagccgggcatggtggcggatgcctttaatcccagctactccagaggctgaggcagggagaattgcttgaactcgggaggtggaggttgggtgacagagcgagaccctgtctcaaaaaaaaaaaaaaagaaaaaagaaaaaaaaattatctgatacttgttaaagatggtagggaaggctttattcaagagggaccactacagtgggagttttgcaatagtggggagagatcaggttgaactcctaatgcaacaaggacaagtggaaatttatagccaaggagcagagtgtgggtcaatgggtggaaagttactaagaggaaaaatccaggttggaggggattcttgttgaaggcaggccagcatgataagatatcgagggtagggggatcagacaccaagggtaggggattttcactaaaatgactcagcaggatttttgctgagactggactaagcaggtcaagatagaacccaaagtcgaggcctagtcagaaagaggactcagagccgggcacggtggctcatgcctgtaatcccagcactttgggaggctgagacgggaggatcgcttgagcccaggagttcgagaccagcctgggcaacatggcgaaaccccctctttactaaaaatacaaaaattagccagctgtcccacctacctgggaggctgaggtggcaggatcacttgagcccaggaggttgaggtggtagtaaaccgtgattgtaccactgcactgcagcctgggtgacagagtgagaccctgtctccaaaagcaaacaaacccagaagaaccggtttcaagtttggtcaaaggagagagtctttgtcatcccacagtgagaacatcaatgtttcttttgtgatttaaagataatttcctttctgtttagccaggatgcaaagtatttttcctggcatgtgaaaagctagacttttattttaacttagataatagggaattcattttataatgagattcactgtgataaatatcagcaattttattgcatttaaaattaaaattatattcatccagaaccttttaggaataatatacagatgctccttgacttacagtggggttacatcctgatgaatccatcataagtcgaaaatattgtaactcaaaaatgcacttggccaggcacagtggctcatgcctgtaatgccagcactttgggaggccaaggtgggtggatcacttgaggtcaggagttcgagaccagcctggccaacatgatgaaaccctatctctactgaaaacacaaaaattagccaagcattgtgacgggcgcctgtaatcccagctactcgggaggctgaggcacgagagccgcttgaacctggggggtggaggttgcagtaagcggagatcatgccactgcactccagcctgggtgacagtgagattctgtctcaaaacaaaaaagcccttaataattagataaacccatcataaagtgagaagattaaacaatcaaaaaatcataagttgaactgttttaagttggggactgtctctatattatttgaagcaaaatgaccagagctggctgggcgcggtggctcatgcctgtaatcccagcactttgggaggccgaggcgggtggatcacgagtcaggagatggagaccatcctggctaacacagtgaaaccccgtctctactaaaaatacgaaaaattagccaggcgtggtggtgggtgcctgtagtcccagctacttgggaggccgaggcaggagaatcacttgaacccaggaggcggaggttgcagtgagtcgagatcatgccattgcactccagcctgggcgacagagcaacactccgtcaaaaaaaaaaaaaaaatgaccagagtcattttaaatgttaattgcctaaggccaaatgaatgtgtatagaatagatgttggaaggtcattgtgggggcattacaccccttctcctcttacttgaagtgggtatttggggattgaggtacttatcacagtgaaagtatgaaggagaaaagtgaatcatcatttagttaaaagatttaccaaaggccttcaatatactcacttaggatgagggaaatgagggatggattatttcagactttcatcttttattgtaacttttttgagaatggagaagggggtcagggatgagtggggaagaaaggttctgcagattactttctagattaggttctttttttcaagttttatttggtagggagagcaaatgaataaaccagaatatgactggaagtgttagaaaattggattcacttctgaatctctgacttgctgccttcatgacgtacagaagaataaggagagtttggaagagaaaattgttaaatggctctgctcgtctctctctgggcctggccatgatgttgcccatttctgtgcagcctccagggaatatggagcagcaaagaggcctaggcagggcgagggagatgggatggacccctcaataccacggagaccggaaggaccagtgtttgtccaacacttgctccgtgtcagcctccatgcacagtatcacatttagtccttacacaaactagttttatccccattttacagattaaggcagctgagactcagaagtgaagaagcttaccaaaggtttcacaacctgcaaatggaggagttggggctggagaacatttctgtctccaaagctcatgccttttctatcaggccctccactcccagccaccatggagtttccagcagggctgggggttgcaggccaggctgatgctagaactcttcctgccacatgacagcaggggaaagagctcaggtttcctcttttaagtggccaggtatgtttcctctcatggcgtcttgtttatgtaaattttatgcacagctagctcagggaagcctccagaaggcactgacctccttccttatggtcaacccacatcttaccctctccgatgtggcatggtagatcactctgcctctgagtatacccaggagatagtttctctggcatgtttctctggcacatgccaaccctgtgtctcagtcagagcccctcctctggaagcacagggtctctggggtctgtggctacttcccagaggggcagagctatggtccctgaagaaacacactggaggaaaatcttaggaaacagttggcacacacagtaggtaaataattgtgaaatgaatggatccgttgcctcctggaaagccctatgaatgggagtggatttacacgttctgttacctttgtacttggcagttttcccatggtgtttatttgaaaacaagttcagattatatcccaggtcacttttgtattgccgctggtaacactaggaacgtttttgtgttaagaaaaaaaaactgctttcaaagttgcctcttgtaatgaatgttctttttctctgctaattaacttattttcttgaacttgctatttcaaaggataaaaattcaactagagactgcaggattatttaattttctctttccaaccagtagtaaccgtgctaccgtgggagcactttatttctccatctgttagactataaaatcatggaacatttttcatgtcttaatagggagagataatgcatgtgagaaaacttcatatatgtttctacgaaaggaacttcctgtgcggctggctaacacaatgagagaagttaatcttctgccggataatttacttaaccgcccttcagtgggattggttcagagttggtaagtaaacaatgtggcttaaaatggatcttcccacaatgctgtgaacatttggcagcgagaccattctctgtaaaagtgcacatactgcccgtctaggtaggaatgagtcatttgggatagctgggttttccatgcaattaaaagttgttttgttttttttcttttagagctgtttgttttaaagttgttttagtgaaaatgcttgttaagttatactagacactttcctgagtttttcttgtgtgtggtgggattgcagttcttctgacaggatatttgctgcttttatcaagtcttaaccttactcctttcgttttccttgtaaagacattccttgaagtcagtacttcttgtagaacaaattaagtcatttaaaggggaacctcagattggaaaaatatcagttccctcctttgcttcatttgctccatgaaaagtaggaaaaattttgacagagtataacataaacttaaatcagttatagctctgatgcttaaagcatatgtcatttaactgaagaagttgaatttgtgacacaaagtcctgggccacccgtgcttttgactgagtggctagacattgagtttccatgccccttttctcagatttgataatttgctagaacggctcacagaactcaggaagatacttcacctatgtttataggtttattagaaagggtacaattcaggaacagccacatgggagagatgcatagggcaaggtatggggggacacatggagcttccatgcccactctgggcacaccaccctcccagtacccccatatgttcaccaacctggagactctctgatggtcgttcaagggttttgatagagctcaatctccagccctctcccctccccagaggttgagggtagagctgaaagttgcagtcctcgaatcacttggcctttctggtgaccagccccatcctgaggctatctagaggtcccgtcctaagtcaccacattagcataaactcaggtgtggtcaaaggcggctccttatggatagcagaagacaatcctatcattcaggtagttccaagggttttgggagctctgtccaggaagcagggacaaagaccaaatgtacttaaatgtgttatattattccggcaaagtataggcttgaacaaattgctatgtcaactctattgtttggtttttgtcttttaactgttccttttccgtatccattccaaacaaatgcatgccatttcttccttcttgtttcttaaacattctattttgaaatactttcctacttaacagaagggttgtaaaactggtagaaagaattccagtataccttcacgtagattcactaattgttaacattgttaacatttggcaacgttctaccattgtcattcagattctctctctctgtctcactctctgcatacacacacacacacacacacacacgtgcgtgcacacatatatataatctatgtctatatatggtacacacacccatatatggtacacatacacgatgtctacatcatgcccctttgccctaaatactttagcatgtatttcattggaacaggtctcagaaaaccacaatgtgatcatcaaatttgggaaatttaacattgatacagtaatgtcttctaatatgtagaacttgttctcactttactactaattgtcctgatactacccccatctttttttttttttttttttttttgcagtttctcctcctgatttaggaatccacttcaggatcatgcattgtgtttcactgccattttttccttttaaaagcgaatcttatgcataatgggctgtgacccccaccaccatccccttggtcacagtgtgtcctccttgctctcttgactgtcaggctgggaacctcaaaataatcttttttttttttttttttttttttttttgagacagagtctctctctgttgccgaggctggagtgcagtggcgggatctcagctcactgcaagctccgcctcctgggttcatgccattctcctgtctcaacctcccaagtagctgggactacaggcgcccgccaccatgccctgctaatttttgtatttttagtaaagacggggtttcactgtgttagccaggttggtctcgatctcctgaccttgtgatccgcctgcctcggcctctcaaagtgctgggattacaggtgtgagccaccgcacctggcccagaataatctttggctccctgctatttatgactttctccaactgtcccctttggaaaggacgggatgcctacctagcttgcttgcatgtggcagggcggagggcatcactggggctggctggctttgacctcttggcgttttgacccaatgattttaacaatatctaatccatagccttatatgcccagagacttttatttatttattttatttatttttttgagatggagtcttgctcagtcgcccaggctggaatgcagtggcacaacctcggctcactgcaacttctgcctcctgggttcaagcgattctcctgcctcagcctcccgagtagctaggactacaggcatgtgccaccacgcccagctaattttttgtatttttagtagagacggggtttcgccatgttggccaggctggtcttgaactcctggcctcaagtaatccactcgcctcagcctcccgaagtgctgggattacaggcgtgagctaacacgcccagcccccagagacttttaaaaagtatgtccatcaatgaacattcattagtatcaaatgcattgtccaaagttcacatgaagctgatgaatcaagtggcattctcattggagtatttatatgtgtaacagtcatttttagttactagagtgtcctcatcctctatccaaaggtgtagataataggattagtggcaattaaagcttagaaataattagaataaagggataattctttcaggacatgttaaaaccccaaatagagatcacatatctctaattggaatatctgaatccccaccagatccaacagatcctggctggatatagctgctgcactaatgggcctctctggatctcatttttctgtgttctccagattttaatgttggacagactgtttcttatactggccctgattgagatatggagctattcttaatccagaagctgtttctgagggtttaattggccttctttctcccccattaagtactgatgaaattaatttaactcagaaggacccttcttcacttctagtttctaagttcttggcaggcacttcagtgtcacacatgtgtttcttaaaatgtataagtacatttttggtaatcaaactgtagacttggtatataagttaggatatgtctgtttgtaagtagaaaaaatgcaaccgaacctggctcatgtcactagaaggtccagccgtagggtgagcttttggtgttggtttgattcagagattcatgaagctatcgaggccctgctttcgatggtgctggcttcattttcagactggattcccccctggtggcagaatagctgcagcagttccaggcttccaatccacacagcactgcacaaaagcagagcaggttgatttctctgccaaagtcctctagcgagtcttttctgtcattttactggcctgaattgagacagtatgtccattcctgagccattccctgtgttcaggggaatgcacacagtgataggcttagacctaaactattgggctaatgaataattagtgacaagagaaatagaattgcccagagaaaaatgggaccacccaggatctttggaggcactggcttccctgatgcacttaagccacatgggggatgcggatgggatggagacctgagtgaaattttggagtgttcttaggaagagggagaggaggggtggatgctgggcaggcaactaacatagtaactcttctttttcttttttttttttccttttaggtatatgcagagttttcttgaacttttagaatatgaaaataagagccctgaggatccacaggtcttggataagtaagtatggtaccacttagctgaaagtaaaaatatctaggtaagaaagattttggtaaatgtaattcaagtcattaagactcaaggagtatgaatgtggacaaaagcgttcattttcttaatgagtagtgactcaacattgagttttttttttttaattcgagctaagaatgtaacacaatacaaaagtaataatgacactttcagttttgcttttatgatctaatacttaatacctttacccaaggtgaactgggcagtcactataaacactgcagtaaatgttccatctagtggtagttttaagaatgcagtggcctttttatatacatgaatttatctactcaatcctttacaattaaaaaaaaaatttcaataggatattacatttgagctcaaaaactgtagtggttttattttggagaggcataaaagtatgtttttttatatagcaacctgaattctattgctccctttatgcacagactggcaaattatcatgctgatgagattcatttttatttatcccaggaacactaactctagctgtgagtatgttttcccctccaagagaaattaaatatccctttcacattaatttcttcctgtttcatgtatatgtaagtggatgcatatggtaggcctgttgtgctgagaaatttctaagtataaactagtccacatagttatgagactgaacacctgacttaatagatgttccataagaagaactagggaaacaccatgttatacaagcaaccttaggaggtatttaacccagtcctctcaatccacagataaggaaactgagttcagagatgtgaagtgacttgcccaagattgtgaccgttcatagcaaagctggacctataagctatgtttacgtctgagccatgagtagctagttctagtctagttgtaaactaaaattcaaaggaaaaacaaaagccctcacctattttatactttgttgggtgtttgtctgatggatctgtgaagtgtggaaggcagggaagcattgggttagagccccagatgtagcgttttccttgatataagccactgctgtcatttaagcgattattaaatgaattcaatccaggagctttgttttctcaaaagtcattagctggtaaccgtttggcagaaatcctaaaacctagggctgaccactgtagctccaaattttagaacaaatttgtagaagtatagttggtcctttgtactggcagtttccacatccttggattcaaccagccacagattgaaaagatattcaggaaaaaaaaaagcaataaaaaataacaatgcaacaataagaaataatacaaaattttaaaatacagtctatcaactgtttacatagcatttacattgtatcaggtattataactagtctagagatgatttaaagtatccgagaggatgtgagtaggctgtatgcactattttagataagggacttgagcatctgaggatttgggtatctgcggggatcctggaaccagtcccctgcggatactgagagacgactatacacgatgttaaatttctgctgtgtttttcccggagtcccgtctcagtttctggaacaggttatccgatgtgatttatggccacgagcctgctttgcaaactgtcagtgctgaatccagtgtgtgcttgacgatagcaataatagctgagctctcactccgtgagttttgtagcttgcctaggttcatgtggttagttatgatagttggcatttgagaaggctgatgttcttggtgaaggaaggagtgaaaggtgagcgagtatcatggtagcagccttttctgtttaccaagaggttgtatgggatcaccagcagggaaatcattttagtaaagcaaaagtagcttagaggacaagcttgttgatcatttatgatagagtttagaagagcccggaagattggaggagaattctgagcattgagccattgaggtaagtctccccacttcagataagttgaggcacttctctactataatgaatcgtttcactttagtaatatttaacttacaaatacattgcaacgagtattacataaaggacaaattgtctattataaaattttttgtgaatgacgatggcctaatttcagagttttacatctttattgtcattgtacgtatgtatttgttacagaaatatttcgtcaaatatttcatcaaatatttcagaaaaataagactattgagataagtaaaaagaaagtcaccccaaatttctactaccaggggacaaccactattactattttcctttcttccgtgcttttccctaggcatgcatatatttatatgcgtaaaatatttttacaaacataacaagtgtcaacattatagatctacaccattattaatagtttcataatattcatgttaatagtccatcttcagatagttcatgcaatttgatcttctatcactggattttagactggtttgtagttttcatgctactataaacaatgctttaaagaacagcttttaaatacatctgttggccgggcatggtggccgacgcctgtaatcccagcactttgggaggccaaggcgggcggatcacctgaggccaggagttcgagaccagcctgggcaacatggtgaaaccctgtctctactaaaaatatgaaaattagccaggcgtggtggtgggcacctgtaatcccaggtactttgggaggctgcaggagaattgcctaaacgcgggaggcagaggttgcagtgagtcaagattgtgccactgcactctagcctgggcaacagagcaagactctgtctcataaataaataaacaaacaaacaaacagctgttcaccttttccagttattttcctaggatcaattcctccaagtggaattattttctttgggcttttgctgtatgttgctgattgtcctgagaagtgcctcagttaagccccaaactctagctgatgctgatacgtggagaataataagtatcacattgttttgatttgcttttcttatttgtaagggtgacgttattggcatttgtgcttcttctttggtaaattttgcattgatagcagatcctttgcctagttttctgatggggtgctagttttttcctttttttaagttttttgttttttttctacttcatttattaatgtgtgtccctataggattgctaaaattctacatagtcatatcatttgtttcttcacattatttgtttctacctttgatattaagcttagaacagccctccttatcccaagattatgtacttattcacctgatttttctgttatcatttctgtgatttcacccttttacatttttaatccagtatttggttttaagtcttgaaattaggatgtgactgaaattgttagcccgctgttccagttaacttgattattagtttgattgtttacctactgatttgcaatgtcactttctcaatatgctcgatttttatatatacatactcactcatgggcctggtcctaaactttttatttagttccattgactgacttgtcttataccattcttaatgtattttcccatatgcatatttacaataagatgccagatacttgaatagtttaatttcctgtgttctgtctgcatttcatcactgtattttactgctgcgagatatttatttccaaattttactcttaaactgtatgagacactttaggaggctgaggtgggcggatcacgaggtcaggagttcaagaccagcctggccaatatggtgaaatcctgtctctactaaaaatacaaaaattagccaggcgtggtggcgtacacctgtagtctcagctactcgggaggctgaggcagaagaattgcttgaacccgcgaggtggaggttgcagtgagccgagatcacaccactgcactccagcctgggtgacagagtgagactccgtcaaaagaacaaacaaacaaaacccaaaaaacagtgtgacattatttctttattcatggaagctattgctttgagattgctttaatcagtccttggagattttgtggggattgtcctcatgttctcagaagaagtactgatatgttctgcaattctttattcaacttttatagaacctgtgttatatgcaatcacttatccaaaaagtctggattcctaaaagggtatttgagcattttttttctgtactagaaccttttactttttgcacttctgaaagaagggtttctgtagaaaaaaagtttcaagcaaaaacttggctcatactttagtttcttgtgggtggttccttgttctatgtagtaagaataatgtctctacttataaaaataccagcagacaactagtctggggacagagctgggaagtctgtgcatcagcccatgagatattaagactgaccacgttttgtttccctctcacacagctttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacagtaagttggagtttgttggtccagttttgaaaaggtaaccatagtgatttctcccaaatgttttcctgttgttaatttactgacctgcatttttggttgtagaaatttcatttctagttcggtttttcctaagtgaatcctagccattacaaagctattaatttgtattcttggttaaaagaaatgtttgaaaggcttttatgaggctcacattagagacaggaccactgcctaccttttaagtctctgctgatacagtcttgatggggatgagggaccgcctttaatggcagccggccttcatctctgaatacttttatgtatctcagattgtattattttctttatccaggatattatgtgttttcctttttagttttaaaaacattgacactggaaatattgaattggatgttggtgataggagccatcagttctttatttcacagtgatcagtgaagtcagattaagccagactgtcagtccataatcccgtattgagagttttagtctgctcttgagggtactaagcagatatgaaaaaaacaactaaaattccctccacacaaaaaactttttggctcatcttcagcactgtctctttggctgattttataatccttgaggaaaagcatccacatgtctagagcataattcaccctgtttgctgcatcacaaagtggacaaaccatctttattttagtaatttgatttatttggataactgaatgttatagaactattaaatgtggccttatattaaatgtatatcttcaaaatggaaatgtatgacaatttacaggaataaaagagcctaaatactgttcaactaaactacttagataactccagttgctttctgatctaaatacacatgtacacatatatacgtgcatgtttttagatcattagttaggcctacacatctctgtttttcttccccttaatcagttcgaactttattaattagcctaatgcctgtatttatcatttttcatagtttaaaatatcccctattttatttaggcatccttcttttgttagtcgcaatttttgcttgatttaaaaataagaacacctataaatatttggatgcagattgcttttttctttggggcttcttttggcttttattcagaaacaaaattttgcaaatcttgtatattgtgaaattatctgagtgtatttttaaaaatacttgaacaagtattgtttgtgtacacaacattgaaacataatctccatgggggaggcatctgaaatgctgccagcgaagacactttgcaagcttgtccaaatggtatagaccacatgttctaaatatttaatgaaagttggagtttgtgtctggagtagtactaagaaggtgggtatacttgactaaggatgaaagtaagtttcttcatccatgtcacattgggagaggaagaacggattgggcacctggcacgtgtcactgctttagaacctgctgactgcaactgacagaccttaaaccacatcctcctccttcattgaccaataagagttgttcacccatcaattgtgtgtattccattgctctaagttgctgtggatgctaaaatgatttttacacataagatatcctttctaaacataagcccctatatttccctgtgtgaccatcccagcctgctgtgttttaatcccctccctttccttttgtgttcgtctagcacttctgtttgggggtgacactaatcctgttcatcctaaacacataggaagtatcgatcccacctgtaacgtggcggatgtggtgaaaggtaaggagaccgttgtaatggtatcgatcgtagttcaaattggattgtggtttattggaggcagcttggctatagggttattttgcagtgcagtctgctgattcatcaggtcactctgggcccaagccactggatccagatgaaatgttctttctaggcagttcaggtaggcagttctttctaggcagttcagcataattggtaaggctcaaaatgtgagtttctactttattgattagagtttcatttgtagttctgtctcaaacagtaaacatttaagtaagattctgattgccactgttatctgaaaatttcagagaatccaaattcttatcataaaattaggttgaattcacgtgtctataaaatttaaacatatttctgttgttcacatctggctttagaatttatgtggcatgtaagcttcatgggttcattggactttaagctagacattgttccagtatcctccgggaagaaccaagccctatatccgtaagtccctggtacccaggcactttgaatttgaacagcagtttcctcattatttattcatttaagatcaatgctatctccaagaaaccttcctggttgtgagcgatccaccaggtacctcttcagttttcttcattgttacggttactttgtgcaacctcagatccccaaattgtccctttctgcagattgtatctcctgtgttggcctttatctcccttctttaaacgctcacctcccaagtttcatggctgcaattctctctgatcttcatcaaggatcttcattgctcttcagcagccatagcaaaggaaaacctctgtaatttgtttaccctgggcattcctaaacccagggaggaggaccagacctgttggttttagcttagcctaggattgtctggctgccctggcctctgttgagtcacaacagatttactcacattatttcagttgtaaggtgaatcagcccagcctcagctctaggaatcctattggttgctctctcacaagataactttgtggttgatcagaacctccaaaggcctccgggggcaaggaggaaagggtcagtcttatcatagcttacatgttcattaggccttagctcagtgccttttatgaaacagaaaacttggttcagacagttgattacccctttgagaaaaaggcacaatttagaaagcaaaagtgcattgtgatatatggtatgtgtgcattttctcttgaactgtaaccaatttgaggtcagggtttgtgtcttatatttgttttataacttgcatagaaccaactgtagtgcttgtgtaggtgattaataaatattccttggtttgatacattttaaatcttttgagaatatacttttaaaaacagctttattgagatacaatctcatatgataaacttcaaccatttaaaatgctcaattcagtgttttttagtgtattcacagagttgtgcaaccatcaccacaatccagttgtagaacattttgtttttttctttctttttttttttttttttttttttttttgagacagagtctcgctctgtcgcccaggctggagtgcagtggtacgatctcagctcaccgcaagctctgtccttcgagttcaagtgattctcctgcctcagcctcctgagtagctgggactacaggcgcatgccaccacgcccagctaatttttgtatttttaatagagacggggtttcaccatgttggccaggatggtctcgaactcctgaccttgtgatccacctgccttggcctcccaaagtgctgggattacaggcgtgagctaccacacctggcctgtagaacattttcatcactccagaaagaaaccctggacctgttagcagtcactcccttctacccttctctttagccctagacaaccactaatctactttctgactctgtatagattttcctattatagacatttcatataaacaaaacaatacaatatgtggtctttggtaactggcttctttcactcagcataacattttcaagggtcattgatgtcatagcatctttcagtactttattcctttttatggctgaaaaatattccattgtatgaatataacacattttatttttctcttcatgttagttgggtgatctcagacttgattaagtaacctctttggggctcagattcttcatctgtaaaatgatgctcttggtaattcacctatattgtagagttaaatgagttcatatttgtagaacccctaaagcaatgctagtacacagtaaaggctgtagacaggtttactagcagcagacagtccttgggtgtcagacatgtcatttggcttcccatgtacgccattgattatataataggttggtgcctttattttgtttctggcataaattataaaatattttttaaagtcatttcaggcttttataagacaattggaaatttgaacactggatatttgacattaaaaatatgttaactttttaggtgtgatattggtatctggtcttgtttttataaaggagtgctagctttgagagaggtatttaaaaatatttacacatgatatgaaatgatgtgagatttgcttcaaaattatacacagggaggggagtgaaaaggactgggcatttgttgaaaattcttgaggctgttgatgggcacatgggctcattatactatgctctgtacttgggtatgtgtttggaattcttcacggtaaatgtatgagtctgttctcatgttgctataaagaactacctgaaactgggtaatttatgaagaaaagaggtttgattgactcacagttctgcaggctgtacaagaggcatggcttgggagtcctcaggaaacttacaatcatggcagaagggtgaaggggaagtaagcacgtcttcacttgatggcaggagagagacagcgaaggggaatgtgctacagacttttaaacaaccagatctcgtgggaactcactatcatgagaacagcaaggggaaaatctgcccccatgatccaatcacctcccacaaggccccaccgccaacactcaggatcactattcaacatgagatttgggtgagggtgcagagccaaaccgtatcaatgaagttttaaaaacacttgttttcatcatcttattgtttctgcacaaataaagtctttcactaatttttagggagcttttaaccaagaaccagtacaactagataagtagcagggagttttatgaaactgttaccacttctatagaacagagcgattaagtggtgctaaagtgagtcagaggtgtcagagtgtgaggaggaatcgactgtgatttgactcttaatgtgaacagaatcgatcgttttatggcacttactgtctgtgttactcttctctcatatttagtacatattacctggccttgtcattatttgtactttcttttttttttggagatggagtctcgctctgtcgtccaggctggagtgcaatggcgtgatctcggctcactgcaacctctgcctcctgggttcaagcaattctcctgcctcagcctcccaaatagctgggattacaggcacccaccatcatgcccggctaatttttgtatttttgtagagatgaggccatttgaccagatgttggccatgctggtcttgaactcctgacctcaggtgatccgcccgccttggcctcccaaagtgctgggattacaggcatgagccaccatccccagcctatttgtctctctctatctagggtgtcaatttctaaaggtctggaattattcttatacgcttttgcatcactcctcttagggtcagaagttttgtaccaaaaagtagctgaaggttatatgaagaatagttcaatacataattgaaagaaaaaaccctggaagtttatgccaatgtctacctcatagcttcctctttgctttgtcccttttagacacagttttgaccctgagccacagtcccctcctttttcttccctcttcttgtactcacagctttatctttagtctttctcctgcgcttattaactatattatacccattattgcactgtgaacaaagtttactgcttcccttacttaatcattcctgccactcacttagcataattaaagcttggagttcctggtgaagccctatacaataacagtcacttcttgtgcccttttgtgactcaaaatccctcttcccccaacacacacatacacatacacatgcacacacacacgcatggacatgtacacacatacaaatcccacctccacactcatggggtaagcaggaaggactggcatgctccccattccccacgcctctctcaaaccatggtttttcatctctcaacagcatcctcccttaaggaaaaaaacagtggaggtggtttcagattccgaaagtgtataaccctctaaagcagcagccacataatcaactttctgacatccttcattcccttcataaacgatgcataccgatacccacagcacactaaatactcttggcttatgtgtgttttctggaatgcttttgtacttctgcttccacctggtgaggtgcatgcttactaagggtcacttatttgtacccaagcccttggtgtaagttatactgactgttgtgactatataatttatttaaatgttatgtaaactgaagaaatatgcatacaagaaagagacttatttctgttaaaaccaagttgaatgctttggaaggactcttaaaaatgttatgaaattactgtgagtaagaaaacgattagattacagggcagcacggagtaaaaatcttacctggaatttatacccaggttgcttcacaagtatctttaagtttattatactttaaagaaataggaattggaattcatagatgtaagtgatattgttcatccaagaaagacgaactggaaccccaaactgatccacattcaaaggaaaggccttatatgaatatactgacagataaataaattgtatgttcaaatgtgcattttaagttaatgtttacgatagtaatcacattttacggtttcccactttacccaacatttttgttaatcatccaactccttttcccagttgggatagttaagaagactaatgccattttcccaaaataataaaagtgctcatcgaagaaagtttagaaaatatgggaaaagagagaagagaataaaaattacctgttttcataatttagtgagaacgttgttttatacatttgaactcatatcagatttatagataggtgtgtagctgcaaatattgtgtctaatctttgtctccgtgaaatccatagtatttttgaatttctctatctccagcactaatgcccatcacacacacccttcctggctgaatttgataccccatggtagaagcctctatcctgctgtctgcgtcagtattttggagttcttcctgtgtctaatctgtgatactcattatctgtatatttaaatggtctttccagccaagtgtgcataacctttattctgcagtgggggattggccttacatcagttactttttctaccctggcaaatgggctaggcaacctagaaggaaacctgcaggcctctcttttccttgtagaccaaagcagatgtctccagtcgactgtctgcttcatttcctatggaccctcctcttaattttttgagcatcaaatgcttatgcagaagctctttctacctccaagtaagactgagagagaataaagaaggcacagagcgccaaaggttgaaaggcctgaaatttcttctgtgtcttctagctaaaaggcactggagtctccatccccaaatgccccaggagcaaccatcagaaggtctcaagaggcccaggcctcaccagctcttcttaccaatccctgccaagtgttgccaaggaagggaagaaatggatgtcagcctcttttgactcttagtgaagtcttactgttgccttcctctttttagagtagttggtattttcaccctggctttgtaccttcttccactatcctctgagatttcttagttaatcttctaactcagaatctctatagctaatcttttatttccttccttttgttttaagcagttggatgttacgagagtaagggctccaggttttaatgacagccctactaatgattttcttagctgtgagaatcctacatggtttaagcatagtcagatgtccagcccaaatgaccctgtgtgggcgtctgtgtgtgagcctctttgtgtgcacacatgtgtgttttataggtttaataagtgttggctaggtgcagtgacacacacctgtaatcccaacactttgggaggccaaggcgggtggatcacctgaggtcaggagttcgagaccagcctggccaacatggtgaaaccccatctctactaaaaatacaaaagttagacgggcatggtggcaggcacctgtaatcccagctactcaggaggctgaggcaggagaatcgcttgaacccaggagacggaggttgcagtgagctgagattgcgccattacactccagcctgggcaacaagagtgaagctccatctcaaaaaaaaaaaaaaaaccacacaaacaacaacaacaaaacaagtgttaagcccactcccatccttagatctcttgagacagattacagaaaactcccatgtagaagagtagagacaatatttttatttttgactagacagttgtatcaacatataaaagtggggtgcatcttgtgtagcattaattgaatgtgcagaacactgaaacatgcctccttgctgcttatttagcaccttagtatctacctttacacatctacaaattatagaccccaggtagtgaatgctagaattagtgttgtaaagcaggtcctattatcctttgggaggtgccttccactgtgacccttttccctcctttctttgtaagaagctaggaaataaaatggaaaatcctgctgtaagatcattttgaaagtataaacttaaatacttggtgtaaaaatcgattctcacagcgatgctaagttgcctgtgttgttcttacatgctattactgcttaatataatagcacacaagtggtatcctcagagcgcgtggcattattctggttcagaaataatgtcttgtgctctcactttgggctcttcaggttacaagtaacagagacccactcacgctagctcaagaaagatttatcaaaagaacctggtaggtcccatgataatccaaggacaggaagcactttatagttggagctatagaaattggaattatcagcctggccaacatggtgaaaccccatctctgctaaaaatgcaaaaatcagccaggtgtgatggcgtgtgcctgtgatcccagcaactcgggaggctgagacaggagaatcgcttcaacatgggaggcagaggctgcagtgagctgagattgcaccactgcactccagccttggtgacagagtgagactccatcagaaaaaaaaaagaaattggaattaggaaacagaaaacaaggttgttttctgtgtgtctttgcagctggagttgccaagtcatggcctttccgcctttctctgtgcctgctcctttacctgtttttgtctgtgtactggacgactcagtggcagcttgttgggcactctagtccttcacagatcatgataattttcagtgtaccattttggcttctgccctgcctgatcaccccaactgtcttgatcctaaattctcaaaagatgcatttaattaactcagcttatctttttttgcccacgatcttgattctgaattcccaaaagatgaatttaattaactcagcttatctttttttttctttccccctacgatcacaagttttaggattctgatcaatctggagattggatattctgctcccactcccacttgcccagtctgctgtggtttggagcgtgaggtgtgggggcctactcctttaaaaaatctccattggatcccacttgggatgggtttggggtaggaaggatgatgatagacatgccttattagaattgctttgagacttgaaagggttcctaaaaggcagcatatcaattccagaaggtggggtgcgggccagtgttgtctctgtgggttctaccatggtgcactgtggccagggccaaaaagtgcagaaggtgaatatagcccatcaaccttaccttcatcttcagatacttgcaaaatagatctcggattcaggtatggctctatgagcaagtgaatatgctgatagagggccgtgtcattggttttgacgagtctgtgaacctcatatcagatgatgcagaagcgattcattgtgaaacaaagccaagaaaacccctgggccagatcgtgctaaaggagatcatattctgccacaaaatgtctctaaccagaaatgatcaaggaagtgagacactattgagaacttgtttttttaggtgtcatttgttgggagtatagttctaaaatgcctgttcagattgtttccattatctgtatatattattaccagatgacagtaaatgctgtgggattgtttttattaaaaaataaaataaaaacaattaaaaacagcccatcagcacttttctaatgttttctggtcatttacatttacctttttgtgacactggcttcttaaacttcagctttatgattttctgtattctgttagactcaaagttagggaccttggcaccttccttttaattttttcagcactcactcaaattcatcctagtccagcctctcatattttttgtctcaaatgattgcatgcattcaagatagaggctaatatttgatagcagagttctgtggtgaattttgaataggaaaatctgatgaaacaacctccattatctgttcaattttcctgtgtgctatttcttaaaacggattcatggctagtttggttctgttgggctgattgctgtgtgaaccttcaccctgttctcagccttttaaaattttagtctaatgcatttacagtttagatattttaacctggggaagtatgtatgagccacacctgcagttttgttaattactttataatcagtaccttaaaacccttgaaaacagattcctaaaagaaggcatgtcacttatattcagtggcaataataattctctaatattttcttctaaagattgatggtaaatattggccccagtatgcacataaaagtaatttggcagttatcttttttgaaattttgatttctaatttaaaaaatagaaaagtttgattagaaagcttattataagtagaatttgcattttactctaaatgtaaattacaagccatgagttgaattttggttttgatggcgattttttaaagctttttcatttttatgttaaattattttacttaaacagaaatgtcctgtttgagtatataagtgctgttaccccagaacctcataatcattcatatcctgggagagatgagtggcagaattagcgtgactcagacttgattttccagggaagtggcctagcttctcttccgaattacctgctaagttttaagaatgtggactctcaggcctcaacatagagctactgcctcggaatttccaggggttcctttcataatctgtactctttcttttaaatttggtaacgaatcccacacacagctagattggggaatgagtctaggcctctagttcccagtctcaccaaaaggaacacctcccgtcagtgtaatttactgcatgttgagaacttaatcatgggtcagaggatcgttccatttaacaaatgctaagtgtgtattgtgtccaaggcattgcaacatgcattgtgtccaaggaatttacaaagatgcatagtatatatgtaataccattaatgccctcaaaatacttttggctagctggtgtatgtgagtctacattgtgatgacttgagttcttcaaggatcatcatgcaattcttaattataacgttgatacactgtaagttgtagtgatgctttaaaaattcttattcgcacgtggttttaggagctgtactgggtctttgtgtttcgagttggctgcttctgtctaggcttggtctttcacatgttaaatttgtgtagcacattttcttaacaacgctgtcataatcatgctactgggcaagcgaattccatgaggaattagcacatttagtgggtttaggttatttttgttttgtagtgaatggaagagcactgtttaaacatctttattacatacctggaggagttgttttgtgaagatgtgttggctttgtgtatcgataatgaatgatcgtttttaggtttcagtgcttgtgatcttggaagtttgtgttcagctttgtgctttcacgtcactaggtggagatgtagcattgtttggcggcataggctaagcaagaggagtgagtcttgatttctcttcttttgacaaaagtactttacagatatttgataaggtttattatagcctaggaaaacacttgtaaatttagtacaattcaaaatttttaacttttttttcaggattgaagttcaatcctacttaagtgtctattttcatactgatcaactcttttaaacattttttttctcctcttactgctgtttcctttttgctgtccctcattatttcaccttgtctgagttattttaatgtctctatctttggttctttatagagatttaattctaaaagtttagtaaaggaatcagaattcttactctgaggtcaaataatagataattaatttggtagcaatatgaagtcaatgaactaaaatttatagtctgaacataccctaatcttatctttgtattattttaggttaataatgtcaatttttaacattaacattctgtagggcttacttttccccctttgcttccttccttctttctctcacctcttgaatattaaacaagcacagtatttactttgcacggtattgatgtggggaatataaaggaaataagagcctgtcttcaaagagctgataatcctgttgagaacattccaaatgcgcccacgaagcagcagttttctactcctaggtatatacccaagataaatgaaggcatatgttcacacaaacatttggacataaaggttcatagcagcactattcataatagccaaaaagtggaaacaacccagatgtctaccagctgatgaacggataaagaaaatatggtatacttgtacaatggaatgtgatatagcaataaaaagaaatgagatcctgatacatgctgtgatgtagatgatgcttgaaaacatgctggtgaaagaagccagtcacagaagaccgcatattattccgtttatgtaaaaagtccagaatagcaaatctatagagataaagtagatccatggttgcctagggctgggtggaggggagtaactgctaatgggttcggaacttctttttgtagtgatgaatatgtaaacttgattatagtgattaatgcacagctctgactatatactaaaaaccactgagttgtatgtactttttttttttttttgagatggagtcttgctcttttgcccaggctggagtgcagtggtgtgatctcagctcactgcaacctctgcctcctgggtccaagcgattctcctgcctcaacctcccaagtagctgggactacaggcacccgccaccatgcctggctaatttttgtatttttagtagagaaggggtgtcaccatgttggctaggctggtcttgaactcctgacctcaagtgatccccctgcctcggcctcccaaagtgctgggattacaggtgtgagccactgtgcccagctgtgtgtacactttactttcaatgagtgaattgtatggcataagaattatctccaataaagatttttaaaaagtaaattaccaaaaggtttaaaatttatcaaactaaggttgttttttgtttgtttgtttttgtttttgttttttgagatggagtctcactctgtcccccaggctggagtgcagtggcacgatctcggctcactgcaacctccacctcctgggttcaagcaattctcctgcctcagcctcccaactagctgggattacagacgctcaccaccatgcctggctaatttttgtatttttagtagagatggagtttcaccatgttggcctggctggtcttgaactcctggcctcaagtgatcagcccacctcggcctcccaaagtcctgggtttacaggcgtgagccactgcacccggctcaaggactgtttgttgaccatctacacaggcactatacgaagttctatgcaagttatgaaacaagtgttaagacacaaacgctgacttcagattgtttacagttcgagagaaaaggcatatatgcaatgtccaatgtcttgtaatgcacctttgctttctgaatctgctccccatctttgaatctcctgaattctgtcttccggctgtttctgtaatggctcttatcttcttaccatatgtcttttattttatcctttaaaaagcggactgttgctcctcagactttgataaatatcagccccagcctgttacctttaactaactcaaaggaccttttaaagtgatagtggcatctccagtaacttaaattgtgtggctcatggaaatctattcattcagcaaatacttactgaggtttcacttacaaataactctggcaaatcacaagactgttggcattattatttttaagatcatgacaaatattcttttgctacaatttagtcaggttgcatggtgcttagaacgtatagtcttgagttcctaaattttcatgaaaaatatattttggtaatagtataagttaaacaagtacgtgtttggtatagagctagctgaattgccagtattctagtatgttgacattgttatggtcattaaaactttgagaaaagaaagccaggcacggtggctcatgcctgtaatcccagcacttttgggaggccaaagagggtggatcacctgaggtcaggagttcgagaccagcctggccaacataatgaaacctcatctctactaaaaatacaaaaattagctgggcgtggtggcacacacctgtaatcccagctactcgggaggctgaggcaggagaatcgcttgaacctgggaggcggaggttgcagtgagccgagatgacaccactgcactccagcctgggtgacagagtgagactctgtctcaaaaaacaaacaaacgaacaaacaaacagaaaatcctttaagaaaagagagattggctgggcatggtggcatatgcctgtaaggccagctacttggaaggctgaggcgggaggactgcttgagcccaggagttcgaggctgcaatgagctatgatcacaccactgtactctagcctaggcgatagagtgagacgctgtcttggaaaaaatagaaaagagaaattttgcattagtcatggtaattctattaaagccacaaaagggtattttgtaaaaggttgtagttgattaattctacatccatccgtttagacagtttatcttatgtacctatagatatatacatgcacatgtgcacacacacacacacacacacacacacacacacacacacacacgcttgtgcctatgttattagtacagcagctaaactttttccttttcttgcagatgcatatgaaacagccaagatgctgtgtgaacagtattacctggtagctccagagctggaagttgaagaattcaatggtaaaagaaaactaattttaaccttacattcaaaaaagctgactaagaagctgtttatacctaagccatatttcagtgagctccaaaaattatactgatttttcattttcttatatctttttaaaactttctacgcttttggtcaaccagatatattattgtaaggagtttttgtacaggaatgtgtaatgtgttagaccccagaattcttggaacagaaataatcaaggtagagtatgtagaaaggtataaataggcccttctcaaagtaacaaatgcaagcagtcgatcaacatatggaaaagtgtttaacttcactaatcaaggaagtgcaaacaaaaacacagacaaatgcctttttttttttttttttttttgagaaggagtctcgttctgttgcccgggttggagtacagtggtgtgatcccagctcactgcagcctctgccttccaggttcaagtgattctcctgtctcagcctcctgagtagctgggattacaggtgccccccaccatgcccagctaatttttgtatttttagtagagacgaggtttcaccatgttggccaggctggtttcgaactcatgacctcaggtgatccacccgcctcagcctcccaaagtgctgggattacaggcgtgagccaccgtgcccagccaaaaatgccatttttgtctttcaaaatgacagtgattaaaacattttaatgctttgaatttgtgcccataaaaatactttctcaccagcacatacatttcttgtataagctaaaagtggtattccctttctaaaaaatgccagcaatgttctttctatttggcccagtaaataagttaataatggtcatattctttggtccagtaaattaaacttcagaacacttattataagaaaatagaggctggacacagtggttcacacctgtaatcccaatactttgggaggccaaagtgggtggatctcttgagtccaggagtttaagaccaacccgagtgacatggcgaaaccccatctctacaaaaaatacaaaaattagccaggcgtggtggcacttgcttgtattctcagctacttgggagactgaggcaggagaatcacttgaacccgggaggcggaggttgcagtgagccgagatagtgccactgcactccaccctgggcaatagtttgaaaccccatctcaaaaaacaaacaaaaatctatgaaaatagagatgcacagatttatgtacaagattgatgatcacagtagttttcttataaagttagaaaacaacccaaattttccacaatagagcattgtttaactgaattgtggtacacccattagatagaatactatgcagccctttgaaataatgctttaaacgaataacgtatgggaaaaattgagatttttaaaaaaatacaggctacaaaagtttatagtagtggagttcattggaaaatattttgaaggatttatactaccaaaatacaaatagcagctctctgggtaatggggttacagatgatttttacgttcatcatatgattacatatttatttgcacattcctttttttatttgcaaattatggaagagacatgcttatcacaaaaatacagatacagaaatgtgactgaaaagggaaatcccccacaactttctcagtcccatatagagctttggtttttgcataaagcatgtatagctttaaccctatttataacgtggttttcacttcaccttgaagacctttgcaagtattaatctcatttagagattatccatagtgtaacttaccataatttatttaactgttttcctatgggtatacatttaggatttcctgttttcctatattccatataatgagctatgaaagagtgtgagaggtggggagggtggaaaaatttgtgaacgtatggaagtatttctgcaggttggattcctagatgtggaatgactgagcagggtgtgagcatttacagttaaagataaaccaggccaggcatggtggctcacacctgtaatcccagcactttgggaggctgaggcaggagaatctcttgagcccaggagttcgagaccagcctgggcaaggtagcaaaaccttgtctctacacaaaatagaaaaattagctggacatagtggcatgtgcctgtaatctcagctactcaggaggctgaagtgggaggatcgcttgagcccaggaggtagaggctgcagtgagccgagatcacatgactgcactccagcctgggtgacagagcaagactctgtctcaaaaaaaaaaaaaaaaaaaaagataaaccaaattccccctcaggagtacactaaaaatgtatttctcttataatgagataaaactgtgaaaggagttcaggctgctgttgaaggacatggcccctccatttgactagaaggcatggagtcaaagctgctttcaaggtctcttgggttctctgagaagagtcatgtccccattgaataaatatactaccaggaccgagtgggcttgtctggagtgttcctgatgagaaccatcttaatattctttctctctcttcctatggactaggcaggagctgatctcacatctgcaggtagtaacaaattgctcttttgcgtgagtggcagcctccctcattctaaaggccaaagcagcaggcctgttcttgctgattcccaagtgccagccatgtcagcacattctgtccccgctgaggctgtcatgctgggcagctcacccaccaggagaggagctttccgactctttttggcattgtctcacgaattacagaagccccctttcgatcatgttttgaagccccttgtcctatcactaagataaatgaatgctggtgtttctaggtagcttctagctttatgttgctttgggtagtgtagtgattatttttatgtataagttcttaatgctagagctctcttgtgagcatgattaaggaatgtgctttcgccttaacaagttctatgttggagatgcaggttggaggttgatcctgaacaccttaagtggatgcttttttattctggaaggagaactgtctggaaataaaattccttatatctaatggtatttcttaaatgctgtttcaactaatggcatttggagcaatgactgtacaaaatagagacttcattatttctgaagtcttgagcatgacaaacctaggccatttttaaattgacttttaaaaatgtacccttagatggaaaattcatattctacttattttataagtcagcaaacatctattaagcatctgctacttaacagccagcctcgagacccagaactaggaaagagtcatggacaaaagcatttgacatggttttaaaaggaaggaaagaaatctaaactgtaatgttcccaaagaaaagtgcaggtaattgagcaagcctttagatggctcctagagaatgttgtttaaactgaaaaaataaaaataaaaaaacccactatataaaaggtgtttgccttttcttgagatttggggtgaaaaggttgaattcataaggctgtttatataactaatcatgccatttggtacaagataaactgagcacccagcttgttcctcgagccccattaaaatgacaataaaggagccaggcgcaatggctcacacctgtaatcccagcactttgggaggccgaggtgggcggatcacttgaggtcaggagttcgagaccagcctggccaacatggtgaaaccctgtgtctactaaaaatacaaaaattagctgggcatgatggcatgtttctttagtcccagctactagggaggctgaggcaagataattgcttgaacctgggaggcggaggttgcagtgagctgaaattgcgccactgcactccagcctgggcgacagagcaagactccatctcaaaaaaaaaaaagaggggaaaaaaagaaataaaaataaaatgacgataaaggaatccaaagaaaagcagcaaaggaaagcagaggagctcattagtggaccagtgccttagtccatttaggctgctataacaaaaataccagagaccaagtggcttcagcaaccatttctcatggttctggaggctgggacatccaagatcatggttcctggagatttggtgtctagtgaggacccaccttctgattcatagctggcttctcactgtttccttccatgggggaaggagcgagggagctctctggagtttctttaaacgggcattaatcccatccataagggctctgccctcataacctaatcacctctcacaggccccatctcctaataccatcacatcaagggttacatttcaacataggaatttgggggagacacacacaaacattccgtccataagaggcatgaatcccaacttttgaaagagggtcactagatggaagtatgctgattggtgggacagagcagaagcagccacaggggaggaggctgcagcagaggtggcaactggtttgccgaagattgtcctggagggactctgggggcagggccaggtggtgcaatggactggaatgggaagggaaggcagagggtagggttaactgaaagctggtctaagaaagagcatggagggatgacgggaggcagctgtactctggccgggttcagcctgccaacaggcaactaagtattttgttcgagaacaacctaggaagaattagggcttttcatgtgagtgttgttaccctgcagcaaagccctgttcgtttaagcatttgggggcctctctgctcagaggcccatttactacctgctcatcctcaagccaagttgaaaagtcttgaccagtccagagagctctaagtcaggcttcccacttaatggagagccccagggggatatgaacgccagctccctcatacagtgaatccggttcttcattctcaaacaagaatattgcaaccaagatggatcagaccttcagcaaaagccagcagcaagaaccaaacctaactggcattaaacttatcagctctactgttactgccagaaaccccccttttgaaattctgagagaaaatcatttcaaacctagaattctctatctagccaaacctttaatcaaatagatcagaggtgtaaagattgacagatgtgtctcccatgcatccctttctgaggtaggttacctgactgccttgatgttatgtataatatgcatctaagaaaggggaaaacattctagaacttcaatcaaaaacaactttaggatgatggctatgcagcatgtttgcaaagcaattgattctaatttgaaaaatcttgaagaatggactggataccatgcagtaggtatggaagctggaagtaggtatggaagctggaagtaggtatggaaactggaagtaggtatggaagcttccagtaagctggaagatcttagcgaaatggcatggaccaactatgaagcaacccaaaaagggtagcatgatgttgaccagttggaggagtataaagaaactccatttcatgttaaggctgggaacattctcctccaagggacacatgaatcattgttattgcattaatagggaagaaaatgtctaggtacactgttgtggttgttctacagtgatcaatatttacatagttataatgtcaccaacacttgattttctactttcttgaaagaacctataggcaatttacagcatccctaatttgggttacagaacagaatgtaaatattaccaacccaaagactacagcagaagtagtaaagagtggctgcctctgggttcagactgaaggataagataggaaagggggaaggacttttgtttttcttcttttgttaaatttttaagccgtttacatatattactaagtgattttaaaaacaactgctcaggccaggcacggtggctcacgcctgcaatcccagcactttgggaggccgaggtgggcaaacacctgaggtcgggagttcgagaccagcctgtccaacatggcaaaaccccgtctctactaaaaatacaaaaattagccaggagtggcggcgcacacctgtaatcccagacactcaggaggccgaggcaggagaatcgcttgaacccgggaggtggaggttgcagtgagccgagatggcgccactgcactccagcctgggcaacagagtgagactctgtctcaaaaaataaataaataaaaataaaaataattgctctttgaagagttcgggatttagactcaaaagctctttgttcaggtgtctggtttcggtgccacttctgggaccacgggcaagtcacacaggcttcccaaagcctgtttccagacctctaaacaccaccacccctctaggagccaggaagtgttgtcaggaggagtcaattgaataatgtatgtgaaagctctgtgtagactgctaagaatcaagcaaatgtgaactctaatttgtattactgttaattactttattagaggaagtagctggttgaaattacagcattctacctgagagagttcatgtagtttcaatctcttaagtgattttgggtcatgaggaggaggaaggactgtatttttgagcatctgctctgtaccgcacactgttcttattgcttcacctgggttttggtgtttctcagattgtcttcagatgacccatggtgcaaggggaaaagatcataggtctctaggggtttatgtgctagctgcttgagaaaaagttatgtgaaccttacattctatgctataagatgccttgtttgtcataatttaacaaaactgaacactgccatttagtccagttcaccagcccttttttttcctgttgctccacattctcccgtggaattccccctggggtcagtggcagaaggtagcccccaatttgaaaaacaccaagtgatatctgactggccttctgtaatactcaggatgttatggcataggtgataatattccaattctgctcaacaaagtttcaaagagattgagtgatttatccaaggtcacatagctggtaagtgaaggaactgggtgtcaccccaggtttgtttgattctaaagcatatgcttttgctcagccctgcctttagaggtggaaactcaaattagccttttatagagctctgttttacacacttggaaaatagaatgcaaacatcattcttgaatttctcctactttgggtccttattgattgatggttttgtctctgttttcagccaaagcgccagacaaacctattcaggtggtttatgtgccctcacatctgtttcatatgctatttgagttgttcaaggtaagtggaattttaaaaacgtggaaagaagtcttcattttaaattactttgattcagggcataatggattcattagattagcataagaaaaaggttttgcataaccattttaaaaattctatttctgatatcctgtgggttttataatttgtacactgtgagatgagaaattgctgtgtacactatagtttttgtgaatattagtacatattgattttgaagcttaattgcactttagtgattttatgtaaaatccatactgttttttctttagttatgagattagagatgctttttagtttccaaacctggcaaaggctttactggtgatagccagatcaaaataaaaacatgtttatacatatttatgcttctgaaaattaaccacactggtacattagtggttgttccagtcctgagagatcctgcaactcttttataaaatatttgaatcaattcagaagatccaagagaggcagaggagaaagatgtagatgagctggaccaaaagaaccacccctcccccccaccaaattctttagagtctgcaacttaagctgttgcttttgttaatcagtagctaatgacatttacagtagcagtattacaggcacaaggcatttgagctaaaatttcatttcttccaatgcgtgaaacactaaattgaacacctgaaaaatcagttatgctgatttgcttccaaaaattagaatgttactgatgtaacgctttaaggttgaaatgggcattcaattgtgaactttctcttcagcagctgtggctttttcagaatttctttttaaccaatatttcttctacttttttcagccaaatgattaatttttgtgggaagcatgcatcctttcagtttttctgccttctttagagaaaaggtgctctataaatgcagactgataaataggatttaaagtgcacaaatcagcctctgcatagcctcattacatgcgataaaaacattcctctgggttgagttgaataatttaaataccgtaaagcgaaaaaaaaaaaaaaagaggaagaagaagaaggaaagaaaaataaatatttagcatgttggatgaggctaaaactaggtgaaaaacaaagtgtcaggaaatttttccttgatttgagcacgtttagctaagctctttagagggaaaaatgccataaaaatccaactaatatttgccccaaaaaagggttgttgggtataagtcatcttgcgcttctttctctttaaaaattgtggtttgtgattcggcagtatgattaataaaaagatcttattattttagaactcaatgagagcgacagttgaactctatgaagacagaaaagagggctaccctgctgttaaaaccctcgttactttgggtaaagaagacttatccattaaggtaactgttttatgtgcatgtatactttaattatcagttgtgatttaatagtatctagacattgaaaaatcagagggaaggaaattgacatttattgagtgtcctgtttgtaagttctatgctagatccttggcttaagttaccttatttaaacttcattagaaccttgttattcagggagttgaacaagacctcaacaccaagcctgttggatcccactgtaccattcggcctcctttgttttacactgttcacaaaggaaccgtatgtcactgggggattcaaagtccttgtacattgtggagtaatctgctatgtactttatttaatgaacccattgcctcctactaagtatagatcaacttctttgttttgattgttaacattttgaacattgcagatcagtgacctaggtggtggtgtcccacttcgaaaaatagatcgtctttttaactacatgtattctactgctcctagacccagcctggagcctaccagagctgcccctttggtaagcatctgaaagtgctgctgaaggaaagatcataaacacaggaaggggctcagagggagctgcctctctccccaggttgtcacattagtgtagttgatttagaaggttgcgtgtattatggtttggaggagggagaattttttgccttggctacttgctttgtgaatcctttggacttcaatttcctctctgatttgtgtctaagaaacactcctagctgagtgcctcattcccatatacagagaaaaagtacctcattgtggtaagactgctactgtagcaccattttccactttgtgctacccttggaaggggtggaagttgccagtgggtgagcaaagggacagtactgaatgcatagctgccgcttggtcctgcgcactctggcgtgcgtaccacagaggcgcgaatcacctagtgccttggaatctccactgtcaaatttgtttatataattaaaatgttaaattatgaaaacattaaatttttatgttaaataacattagcatgaaacatataggtggtgtatgcattttcagagccctttctgtctcactctggaaataaccttcagccctgttaaggcagtgagaaaagccactggttaccatggtagcatttagatcctggtagggccacacttgcttcccctgctgagtgtttctaattgacaaacaacaattgaaccctttgtcattaaacacagcaacatatctatcagtctgcaaaatggttcagggtataaattaagtttcattttaaagtcgtacctgactgataagcacataagattatattttatttgtatgaataaaatcaaacactttgcatcatttatttgagacagagtttgttaactcagcatgttggaaacaggaaatcatttatataggagtcgagaaaattcatgaaagatcacatttgagaggcgttgccttgactaggctctggcatgcacttaaatacacatcaaaaggaaaaaaggcaccacaaacaaatctagcaccttccccagttgtttaaaagaaatatagattgtctcttccaggtcttaaaatagcatcttgaggatagctgttatatcataggttttttttcttattgaaactgagggcttgtaagagacttttaacagttaacgcatgcgcactcccattgtatagatgaggaaatgaggaaatgaccttgtccaaagtcattgaactaattaactgcagagctggtgctggccatgtctgtgttctttccagtgtactacgtggccgaagaaatgcttctgctagtggctctcccagttaggaaactggcctgtaatcctagcactttgggaggccaaggcgggtggatcacttaaggtcaggagttcgagaccagcctggccaacatggtgaaaccctgtctctactaaaaatacacgaaaatagtcgggagcagtggcgcatgcttgtaatcccagctattcaggaggctgaggcacaagaatggcttgaacctgggaggtggagattgcagtgagcctatatcatgccactgcactccagcctgggcgacagagcgaggctctgcctcaaaaaaaaaaaaaaaaagaaaagaaaaagaaactgtcctcagctttaaagtgggcacatggatatgtactactagaaaacataatttcctcattgagcaacttacacttttacaccttttacacctctgtgcctttacatgtgcatttctgtttgagaatatccacccagcgaactcctgctgatcctttgacactctgggaaacctttcctgaacctcagcaaatccgaggtccagacccctcctctgcattctttgggagtctgggcttacactcacatctgcattggcctcggagttctcggctcttctgtgttggacatgagggcaggctctgggccttgcttgaacatagaaggcagatttgctcacatctcttcctagagtgagctagtttctttgctgtggttacctgagtcactactataaatatctcatcttcactactggccatattcagcaagtcccaaagcccttaaataatggggtacgttcttttaccccctgccctttcagttaaaccctaccctgagggaaggtatcaaggagagatgttagaaaatggcagaaatctgtgtaacttcataaaattgctgctcctagtagccatagtaccagcctcaatttatttagttttactgtgttaggcactgtgccaagattttatacttgttatattatttaatccttatagcagctctgaggtcagttttttatcatatgttcagatgaaaacatggtctcaaagaggttgagtaaactgctcagagtcgcacagaaagtggatttcaactgggtctgtctgagtctaaggcccatgtgactctgtgcacatggtcccctgccctccttccttaaccttgttcatagatttaaccagaagtgaggaagcttggtgttacatctccttccccaccctgccccactaccaccacaaatggtattacatttagttttgattcttactgttcttgtccatagaacacctgttattgacagtcaggattccttgacatagagatataggagggtactgaaaatttttttaatctctaaaaatacctgaactacaatataccaaaatattctcacattcccggaaccttagtagttgcctctcagaaaattgttttcctttccatgttctcgtcttgttactggtagatttgtactcagcactgcgctattgattttcacttgcaaaagcaaggaaatctgatcatgggactttgaaatgatgtggtttagttttgtcatcaggtcacattccacttgatttggaatgtgcttttgtgtgtgtgtgtgtgtgtgtgtgtgtgtgtgtggagatggagtcttgctctgtcgcccaggctggagtgcagtggcgccatctcagctcactgcaacctccacctcctgggttcaggcgattctcctgcctcagcctcctgagtagctgggactacagtctcccaccacctcgcccagctaatttttgtagtagagatggggtttcgccatgttggccaggctgatcatgaattcctgacctcaagtgatccacctgcctcagcctcccaaagtgctgggattacaggcgtgagccactgtgcccggccttggaatgtgcttttaaaaaaatgataaaattttgctttaaaatgctaaaaaagcattagtcaaaaattagaatatttctattattatccaaacatataagacatgtttttgcagggtgaaaataaaggggttgtttgccatagaagaggatatacatcattgtaaaggttgagtcagtaatttatttgatttaaatctgaatcaagaatttattttaaccttctctgaatggtcatcatataaaatgtgttagcatttgtgcctgtctcactgtattaattttcttttctcaataggctggatttggttatggtttgccaatttcccgtctgtatgctagatattttcaaggagatctgaaactgtattccatggaaggagtgggtactgatgctgtcatttatttgaaggtactgcgttttatttgttagtatgaggcatctttgctttttaaagctgtaagttctaatcgctgattgagaacagcactgtatcatctcttagattcatctcagatttacttcattttcccatgaaaaccatgttatgcctcacgcttgattctatgctcagataaagcaaaatatgaaacgtggaggtatagaaattaaaatactgattttggccgggcgtggtggcacatgcctgtaatctcaggactttgggaggctgaggtgggtggatcacctgaggtcaggagttcgagaccagcctggccaacatggtgaaaccccatgtctactaaaagtacaaaaaattagctgatgtggtggtgcacgcctgtagtcccagctactcaggaggctgaggcaggagagtcatttgaacccgggaggcagaggttgcagtgagccaagatggtgccactgcactccagcctgggcgacagaatgagactccatctcaaaagagaaaaaaaaaaattaaaatactgatttttaaaaccataattttaaattgtgacttaaaaaactacatgcctattgaaaggtctgatctaaaagaaggcagattttcataaactgaagtattttggtcttttgttttaaaaactcactggctttcccaaagctacaagaattcagtaatcataatatggttatgtaaaagattcatttaataacaaacttctctgtaacacagtttttcttattcattggtgatcattgggcttttatttctaaactctagaatatttgtaacatttttttgaataggtaatataggcacataataaaaatttaaaagctacaaaaggaaaaatgaagtctctcctcccactggccctaaaccgccagttctgttcagcgaagatcaccaccggtctcagcgtcttatggatcctcctagagttgattctacatttataaatatgggaaaaatagaatttttcccacataaatgaaatttcagcaccttcttattttttttactttgcaatctgtcttagagatctttccagatccatttatgtagaactggctcattcttttaaacagtggcataacatgccactgtgggtcaagcatccctaacccaagaatctgcaatccaaaatggttgaaaatctggaactttttgagcgccaacgtgatgcttgctcaaaggtcaagcttaaaggaaatgcttattggagcaccccagatttcagattttcagattagggatgcttaacaggtaagcacaatgcaaatattccaaaatcggaaaaaatcagaactacttctggtcccaagcatttctttctttcttttctttttttttgtttctttctttttctttttttttttttttgagatagagtctcactctgtcacccaggctggagtgcagtactgccatctcggctcactgcaacctctgcctcctgggttcaagccatgctcctgcctcagcctcctgagtagctgggattacaggtgtgagccaccacacccggctaattttttgtatttttagtagagacagggtttcaccatgttggccaggctggtctcgaactcctgacctcaggtgatccacctgcctcagcctcccaaagtgctgggattacaggtgtgagccactgtgcccggcctgttcccaggcatttcaaagggatactcaacctatgtatgtgataccagaatttaaccagttactgggagtatttatcttagatgcccatgcatctaagtaatgcgatatttaatatacttgatggtgtgtgtttataaacctgggatgcatgagactgtatctcttcctgggccctttgtgagaccagtcaccaggtatagtcaaaacagttgagcatctcaaagcagtatgagctgaattaaaatatgttttgttctggtcatgtgtatttcagttctgattttgaatgagcaaatgttttcattcctttaaaaaagctttaatgttttcctggccagtctaagtaaactactaaggtgtaattttaatatcattttgaaaatatgtattaaggtttctgatgttttaaataataaaatttgggttactatttcacttgagaaaaatgacactgtcgacctttggtgtatatttttgtttctccaataggctctttcaagtgagtcatttgagagacttccagtttttaataagtccgcatggcgccattacaagaccacgcctgaagccgatgattggagcaatcccagcagtgaacccagggatgcttcaaaatacaaagcaaaacagtaatataccaccttgatttccattacaaagtatctgatttgtctgaataaaggtgtcccactcactgttccaggaattcttgcagtgtagaggtattcacaacagcaagcagggatttggcctgccatcaattttatttaaaaagcaattaagtttgcagtttgtcctcataaacgttgtaggttgaaactgaaaaataagttaaaatgatcaatcaagataaaaggtgatctatccatccaatggaatattatttggccttaaaaaggaaggacattctgatatgtgctgcaacatgggtgaatcttgaagtcattatgctaagtgaaataaaccagacataaaaggacaaatactatgattccacttatgtgaagtacctagagtagtcaaatgcagagacacaaagtggaagggaggttgccaggggctagcgacgaagatggaatggggaggcattgtttcatgggtacaaagtttcaggtggaaagatgaaaaacttctggagatggatggtggtgatgcttgcacaacagcgtgaatgtactcaatgccactgaactgtacatgtagcaatggttaagatggtaagttctgggctgggtgtggtggctcacgcctgtaatcccaacactttgggaggctgaggctggatgatctcttgaagccaggagttcaagaccagcctaggcaacatagtgagacctctgtctcagcaaaaaatttaaaaaggtaaaattagccgtgtgtggtggtgtgggtctgtagtcctagctactcaggaagctgaggcgggaggatcacttgagcccaggacttccaggctgtagtgagctatgattcgcaccactgcacaccagcctgggggacagaataagaccgtgtctcaaataagaaaaaggtggtaagttctatgttatgtatagcttatcacaataaaaaatgttaacattataaaggaaaagttatcaatcacagaacaagtttcactgttttatggtaataaggaaaataatctgtagttttcttctgactatgtacccttaagcttcaactctactagcaacagtggggttctgcttcatttaacttaaaataatcctgtattaacaaaaaagcagtatatgtgcattataaaaaataagaaaacattggctgggcgcagtggctcacgccagtaaccccagcactttgagaggccgaggtgggtggatcacttgaagtcaggagttggagaccagccaggccaatatggtgaaactctgtctctactaaaaatacaaaaattagccgggtgtggtggcacacgcctgtaattccagctacttgagaggctgaagcaggagaattgcttgaacccaggagacagaggttgcagtgagccaagatagtaccactgcactccagcctgggcgatagagctagactccatctcaaaaaaaaaaaaaaaaaagaagaagaagaagaagaagaaagaaaacataagtaagccaaaaaagaaggagaaacctctgtgttcccaaaacccagagattgccactgctatagcttcgtgtatattcttccagatattttgccatttgtgtatatatgtattttttttgcaaatgagattacactattcatactattttacaacctgcttttgtttcatttaaccatcccatctttccatgtcaatgatcattcactgcaacctctgcctcctggcttcaagtgattctcattcctcagccacctgagtagctgggattacaggcgtgggccaccatgcctggctaatttttatatttttagtagagacagggttttgccatgttgtccatgctggtcaaaaaaaaaaaaaagaaagaaaagaaggaaggaaaggaaggaaaagaaggaaggaaaggaaggaaaagaaggaaaggaagaaaggaaggaaggaaagggagggggaaggggaagggaggggaggggagggaagggaaggaaaggaaaggaaagagctaatggagcattttttgctagaatatccataaacactgttgcagaattacactgagacccatgacatctcattgacccaccattagtgatgttatgattgagcatagtttaggtgatggctgtctgatccctctgagttatagttatttttccctttttcactagaaaataatctgtgtggtgttattttggcactatgcaaatgtatacttacccatcagctgttcacctaatggtttttaccccaattgatcatttcggcctgtgttaaaattaacacagtaattttatttgggtttataaaagaatgttttttttttaaatcattcctttgtcaattattctcctataaagtaaagctcttcctcatcaaataaggccatttaggtattttgaagtacagttcctctggtaactgtttaactccttccttttaaatttaaagggacaattaaattcccttcaagttaccaattttccaggtaagaaatatgttaaaagccaccttaaatggttaacaaatgagtttatggctttgtcttttttagtgttatagtagattttgttactttgatatgttttaattggcacttattttattgaagcataacatatagtaatagtaaagtgcacacatcttaagtttacagcttttttttttacatctatatttcctctacccacaaagactcctttctagtcaaacagttgtccctccctcctccaccatataattgcttttctaactctatcaccataggttctcttcttgaatttacaaggaacacatagtctatactctttttgtgtctggctttatgtgagattcatccatgttattgcatgtaacagtcattttcctttttgatgcttgaattgacatacctttggccaatgagagctatttccagctggatccttagtgttctattgccaaaactcattaatctttgaaagcttttcttgcccaagatgatatcctagattcatcttataccttctgtgcctgtgtcctagaatcaactgtttccctcaaggagtcttgtttcttttcttttcttttttttttttttttttgagacagagtctcactctgtcacccaggttggagtgcagtggcgcaatctcagctcactgcagctctacctcctgggttcaagcgattctcatgtctcagcctcccaagtagctgggactacaggcatgagccaccacgcctggctattttttttttttttttttttttgtatttttagtagagttggggtttcgccatgttggccaggctggtctcgaactcctgacctcaggtgatctgcctgccttggcctcccaaagtgctgggattacaggcataagccactgcacccagccctgtttctttttaatcagtattagagatgctaatctgataattggggatgcttgttataccttttttaggcccttttccttgacagacagagctataaaatatagctatatttaaaatatattttaaatcataagttcatattgatattttattctattttaacattgtaatgtttctccccaatatattttaattgtatatatttcttattatcctgaaaaccttgatttttaacatctttaacacaatgcaacagaaagatatttgtacacaaatacagtttatatagctttgcagtattgtaccatttagtagcgttggtcttctctgacaagtgttataaatgatatccatatggatgtttatttttttctatggaagtgtcatggtggactgctacgcaatattgctggactggccactcatctcaaatgatgaagtttagagaagtttggtttgtggaaacaaacatacttactctcaccattcccagccaagtttaagctaaatcagcttgaaatacctggatcatatcaatttctgttgattccattttcagtctgtatgtaagtcaaatagaatgttgagcatcgatgtgaccagttgattcaaactgctcaaactattgctctgatatgtggagtaatttgagtagtgcagaagccatctttagaaaaaggtttggttgtaaaaaggtggctttaattgaatattattttaaaggcaatttttaaactaaggtttaaactaaggtttaaattttaaactgaaggttgtatgctgattattagtcttaacttctaatatattattaggtgaacaaatttaagcagaaagcagttcttaaaattttaaaatgcttagcctgacagttaaaattgttaaactatacaaataatcggtagagatttggggaaagactttagtaagtatggtaaattcactaggtatttatacatgagaggttctaagaaaatttattttcaaaacagtttctaagtgagagttttattgagattaattcacacaacataaaattcaccctttacaaatatataattctggccgggcacagtagctcacgcctgtaatcccagcactttgggaggccatggcgggtggatcacttgaggtcagaagttcaagaccagcctggacaacatggcaaaaccccgtctctattaaaaatacaaaaattagccgggcggtggtggcgggtgcctgtaatcccagctacttgggaggctgaggcacgagacaaacccaggaggcataggcagcagtgagccaagatcacgccactgcactccagcctgggcgacagagcgagactccatctcaataataaataaataaataaaagtatacaattccatattttttagtatattcacagagttgtgcagcccttcccactaactttagcatattttcatcaccccaaaaagaaacctcatagtttttagcagtcactctatatttctaaccagagttttcactgacagtaaagaaccgttttaaagtatatataagtaattaaatggtcattctatttctgtagtaattgtagaaaataattctgagatatggcaagggtttttgaattatcactataatgaaatactctaaaagtcctggtcaaaacagaggaggttgtactcacaaactcactatggatattctcattattttctttgtagagacaagatcaagactaatagaactttctagaggactgaatgctgtggtcctctctgtgaagaaagattgccttctgcaagtcaaacagagagaactgctttctcccacctgctctgagcgtggcatcacagttattcctagtgcttaaatgtgtattttctctctaccacctggactttcccaaagagtttttcctgtagctactccagatcttccactaaagtagtaactttttaatgacatcttgctgtggtgtgattgatgcctgtcaccgaagagcacagagcctccttacagctcttgtgccctcgtactctccatcttgttatcatagcatctgatgtcttcagtccttccaggattctgtgcgcctttcccattccagatacagcagatcgtactgttgctccttgtgaccaaataccatatttgtcccaaacctccacctagggccctgggaccctgaaagtggaagacatcaggtggccatgccctgatgatttagtcccagagccctccgtctctcccgtgcctccctccgccactctatgatttagacttttgccttcttccatctgatcggattctcattgtgagatgtggtgactttcatgttagatcttcttcattgatgccttggttttattttaaaattcatttgtatatgtctgttgattaaagcattcgaaatgttatcttagaa

SEQ ID NO: 3305 - DNA, 69204 bp, human
cgtacgtgcagcaaccgactccgcccagcgaggcggagcctagggaagccgcgggcggcccgccgctgtcctggagctgctgctgctgctgcggcggctgcaccggcggcgccgaggccgagatcgaggccggggtgcgcgcttcgcaaacgtgccctatccgtgcggcttggctgcgccagcccttgcggccacccgggcgtctaggcgggtctgtgcgccgcccgggcgaggatgcggctgttccggtggctgctgaagcagccggtgcccaagcagatcgagcgctactcgcgcttttcgccgtcgccgctctccatcaaacaattcctggacttcggtgagtacggggccaagggtccccatgggcccggggccgccgccattcgggctgccaccccggatctccgcagcttcggggtaaagtctgtgggaaccgcaggcggggctagggaatatccggggggctctcctggggctcggatttcggggcgcggaggggcagggcctggccccctcgcacccagcctgggacttacccggagacacagaaacggcgtctcattgcaggaccctcatcgcaggcgagactccccaaacctgcggtcgttagcttcaaatctgcttgacacaaacctcacagcccttaaaacttcagaacgagatgtgggtggctttttaatgtttttatttttagaattttttttttttggttgggtaagaactgtttagaaataccttgaggttgaataaattatgcaatggcattttgttccttttctgctctaaggtgttgctgtgtggctggagtggcaggactcgaactgttgtcttcatcaggttatgttaaatcagttagaggcctggcctgcagacgccttagatgcttgggaagagcggacgtctgggatcctagcatcagagcagggtctaatacaactctggctttagtgccagcacctttcgtttctcttctccattggtgtcccacccacattctccctgtccggtgggctggtgggcggctttcacggattgaggtgggaccaaagaagattcgggttcccagcctgcctcaggcctagctgagatgggaatagattccaccaccttctgttaactgaatcatgtttccccagaaaacgaaggagctggttgtgaaacacctaaaagtaaaacgcatgcattgaggtatcagaatggaactcagcatccctggaggaaaatcaaatccagcagcaaagatgttctaagctctccaggggaaatcgtagggtgtctgttcatttaatgaattttatgtaaatgtcaagggtgtcagtgatagtgtcagttgggcataaaaactaaagtgcagagtaggtagaacatttgaggaagacctgatatgcaaaaagtgatgtccatacttttttttttttaaaagctaggataggaagagaggaataggttaaagttgagaccaaattaaaattttagaagccaatttgccagagaatgatgatgaaagtcaaagttcaatgacacgttgatttctgcatcttcaaacttcactcccaaaagctattggtagttttacttactatctcgagaattgtagaggtttgaggcagtttctgactttagagtttagaaaatgttgctattgctataaatataggcaagttttccatctttatggtttagggaagattctgaaggtatcagcctttcattagtgtaaactgaaacaggataattcacaataaaaggaacaaaaggaatccagaaactcccagttctttccaccctcaaagtttaagtgatagctccaatagccagccaaaattttggttagttgatttccatagcagctagtgtctacccgtgttaataggtattttggtaaggatgttatgtgagtaggaaaaccacagtggaggatagtgttatcatggaaaacctgtgaggccagtatctggaaacaaatgttctaattctggctctgccactagctcagaatgtggccttgactaagtgaccaaacctcacttggggttcattttcctcattaataaaatgagtagattgtatcaggcgatctttaaaagcacagctcaccactatacgattgtgatttcaaaggaagaggcatgaactttctaaaagaaaactaccaaatcttttgatagatatttcctataaaagtcttctgacctattttgggaggggtggagggattcactaaggtcatgagagaagcataataatttaaggttttccttataaggaagcgcacagaagtgctagatatagttgtagtggaatttgctagaagtgacaaggctagtttgtaacacccagagatgaatcaggtgctaatcagcctatctttaatgacaggacaactaaaagacgggagttgttgcaaaaaggccatctctacttctacttttctcttagttctgtctcttgatagcagttctattttggcaattgatgtgggagttggagaattcagaatgggtgtgggatatttttaaggtgaggagagaggaggagtgaagaggcttcatgcccctgtatgattagagaaaactgcaggagagggccaactcaggcacttaaagcaccaggtagtgggcagtggataagtgaatgaagccaacgagttgaggaccgtgataaattcctggtatatagctagctccaaaggggcagctgattggcaccaattcagtatatttcaagagaactttggcataaacaaaatagatggatggatcaagttggcccacaggctgctagtttatgaacttgatgcctttctccatgggtactttacaaatgggacgtacattttgactagagtaactagacagggaccagagaaaggagatacacaggatatacacaatttgttacaaccttgataaataggctttcttatgtggatgtactgcacatcagtaaataaggagattatttgctatgttcaaaagtggaggctaaaacttgttgttacttcagaagctgtgcttttattttaaagcaggggttcctgagcctcagcactcttgccatttcaggccaggtaattttggtaggagctgtcttgtgcactgtgggaagttgagctacatccctggcctctacccactagatgccatgagcacctcccactccaagtcgtgacaaccaaacatgtctccagtcattgccaaatgtcccctgggggagcaaaatgtcccctggacttctgttgaatcactgtttggaagtgtttacttgagtggttttcaggccagggcctcatactctgaatttttgttgtaaatggtctgggggtgctgggggtggagagcagagcactggtatttttaggagatccccctgtcattctaaagcatatccagggttaagcaccattaatcagatgatcttctgtctgatctgctggccccctttcatctatgtgcagtatttttctctatgctttttaaaataatgaaagtttcttgaactccatcttgacttgaaatatagcctgccacacagttagcaaatatagcaagaataacaagtgttctaaatggatttttaatttattatggcaatagtacattccaaagggtggcattttttaaaatgagatttttcttttgggcctaagattacagtcacatggttccaaattcagagggttcaaaaggacacagaaaagcctgcttcccacttgtgcccactggcctccccttttttcgcataaatggcagtttatagctttgtctgttccttgttttttgagcttaataccttagagacagatttttgtatatctgtacctgcagaactttgtttttcttttttatggcttctgagaatttggttatatgaatgtaccagaatttattagcaactttccctattgatggctacaattaataggttgtttctagactttgctgtggcaacctgccctccagtgaattattatatgcattgtcatttcatgcatgtccgcgtgtatctgtaggacagattcctaaacgtgagattgctacatcagcaggtatgtgcatttgtaattttggcgaacattgtcaaattgctttccataaaggttgtttgttttccccctcgctagaagtttctgagagtacctgttttcctatgccttcaccacattgttgtcaaacttttgataggtaaaaaaaaaatgatatatctagatagaatttttttctccttgagtaaagatgtctttattttagttttttattgtggaaattaaaaaaaaaaacttaggtgggtgcctgtaattccagtgctttgagaggccaagacagaggatggcttgagaccaggagtttgaggccagccctgggcaacatagtgagatcctgtctctaaaaaaaataataataataaataaataagattagccaggagtggtggtatcgcacacctggggtcttagctactcaggaggctgagacaggaggatggcttgagcccagattgaagctgcagtgagctgtgtttctgccactgcactccagcctgggggatgtacatgtataggtaaatacatatataaattttattgtgtataattaaggtatacaacatgatgttatgggatacatatagttaaaaggttactacagtgaaattaacatatctatcatctcacatagttacccttttttatttttgtggcaaggtcagctaaaatctactcatttagcatgaatcccatatacagtacaattttattatctattatatattcttcatgttgtgcattagatctctagaccttaaacatttacagaagtagagagaatagaatgatgaactcctgggtttgttttattgatatccatttgctatttgtctgtagatgttgtatgtgtggtctgttagattttctgatcaaagtcatgcttgtttcaaaaagataaatttttgttttcaaaaagataaatttttttcttttcctatgctaagactaatttatcttttgaattatctggttcttaaagatttggtagaacttcatatgaaagtgtttaagcctgtatgttttggggagttttgctctctgatagctttctctattctgtgttattgatctctgtagattttctgtctcttctagagtccattttgatatatttttcttgaaaattatcctacttggctaggcgcggtggctcatgcctgtaatcccagcactttgggaggccaaggcaggtggatcacatggggttgggagtttgagaccagcctggccaacatggtgaaacctcgtctctactaaaaatacaaacattagctgggcatagtggtgggtgcctgtaatcccagctactggggaggctgaggtaggagaattgcttgaacccaggaggcggaggttgcagtgagccaagatcatgcccttgtactccagcctgggtgacaagagtgaaacggcatctcaaaaaaaaaaaaaaaaaaaaaaagaagaaaagaaaaaaagaaaattatcctactcattgaggtttttaagtcagtttggatagctgagatagttgtcactgaacagtcttaattttccctgtgacatttgtccccccccttcttcttgagtaggttagttgatgatttattgggttggatttattagttttatgacttttgttatctagtttattgtctgatttgactttaataattccttctggtctcaggtttattttgttcttttaaaaattaggtgctttctgttctcactcataagtgggagttgaacaatgagaacacatggacacggcaaggggaacatcacacaccagggcctgtcgggaggtgggggggctaggggagagatagcattaggagaaatacctaatgtagatgacaagttgatgggtgcagcaaaccaccatggcacgtgtatacctatgtaacaaacctgcacgttctgcacatgtaccccagaacttaaagtataataaaaaaaattaaatgctttcttctttgtcttgtttatttcaatgtttaaggttagttattcctctgagcactgctttagcagctgatgtgtgtatttggtcttttttctcttagctcttctgtgtcttcaggtttttattttcctatgaatgaagagttgtttggaggagttaaaaatttccagtgaaggtgcattctgcattttaattttatttatgtctagttttgttgcactgtgattacagaatgttgtctgaattattctctaatttattgatgttaactttgaagctcattatatggttgttttctgtgaatgttccttgggcagcgaaaagaaggttatactctcttctcaggttgcagagtgtgatatgtcagctctgcaatattatgttatttaggttttgtgtaactttactttttttatccacctgatttgtcatggatcaaacacaagagaagttaaagtctcctaataatgattctctttctccgtatagctcctattgtttttgctttatgactatcagtgttatgtttgatgcttattaactcacatcctcattgtgagatatacccattagcattagagtgctgcccttttactagttgaaggctttttggcctggattcgtccttatttgacattgagatctagttccctattttcttgtttacatttcctgggatagcattgccatccttttattttcagtttttctgaattacttcgctctaaatatgtctctaaatgtagtgtaaagttgggttttgctttgtgaatcagtctttttcatgtggtaagtttaacctatttatacttactggtatgatagatctgtcatctgtaatgataagcatttgtaattttctgttgctttctgtttttaatacctcagttttcctatgttatatatttgctttgttttgccatatttattttaataaataactaggcttgaatttttggttctagtggttatctttatagttattactttatttctatagacctttgtcccatatgggtcaccacttgtcagccaggagacctttgagcacttgaaatgtggctagtgtggccgaaaaactgaattgacttaatttaaatttaaaatggatacttgatgcagttaatttttacatctgtgtagaataacttggatatggaatccactttatcacctgtaaattttaggaaatctctttataggtcaattatttctgatagaaatttagcctctgaattgagatgtgctttcagtataaaatacacactggatttcaaagacttaatataaaaatagtaaaatatcagtacatcttatattgattgcatgttgaaatggtaatattttagatatgttgggttaaatggaatattatcaaaaactttatttcttttttatgttaatgtggctactaggaaattttaaattatatatatggcttacatatttctttctttcttttttttttttttttttttttttttgtgagacggagtttttgctcatgttgcccaggctggagtgcaatggtgcgatctgggctcaccgcaacctccgcctcccaggttcaagtgattctcctgcctcagcctcccaagtagctgggattacaggcatgcgcctacatgcccagctaattttgtatttttagtagagatggggtttctccatgttggtcaggctggtcttgaactctcgacctcaggtgatctgcccacctcagcctcccaaagtgctaggattacaggcatgagccacagcccctggcctggctcacatatttatattggacagtgtggcttcagataatatatgttaattccttattgggagcaatgaaaacatcacattttaatgttcagaataaacatttattggctgggtgcagtggctcacgcctgtaatcccagcactttgggaggccgaggtgggtggatcacgaggtcaagagattgagaccatcctggccaacgtggtgaaaccccgtctctactaaaaatacaaaaattagccaggcatggtggtgggcgcctatagtcccaggtactcgggaggctgaggcaggagaattacttgaacctgggaggtggaggttgcagtgggccaagattgcgccactgcactccagcctggctagagtgagactccgtctcaaaaaacaaaacaaacaaacaaacaaaaacaaaaaaaccaaccacacatttgttgaatttatttatttatttatttacttatttgagacagagtctcactctgtcacctaggccagagtgcaacggcttggtcttggctcactgcaacctctgcctcccgggttcaggtgattctcctgcctcagcctcccgagtagctgggattacaggtgtctgccaccacgcctggcttatttttgtatttttagtagagacggggttttgccctattgcccaggctggtctcgaactcctgaccttaggtgatctacccgcctctgcctcccaaagtgctgggattacaggcatgagtcaccgtgcctggcctgaatttatttcctgaaatataactttcacatgtcttgttccatatttttttctataaacctctctggatttttggatcaatgtattgtttttgactggcagttaatgttatggtggctccttgttatatttgcacaaatttgagttctctttcccttaagcagttgtgataaattaaaaattctcttaattatataagaaaaggagaacttggactattatggcataaagatagaaccttctgaatgttgaatgagttggtaggaaatgattcacattttcttttggacttgcttttcatctttcagtctcgccctgtcggcttctggttcccatattaaccacttttctcccctccctgcagactgacgtcccatttgtttgattttccagttacttttgcacagccacacttgcattaaagagattttgctcctgcctccttttcttagattttatcctcaattgtctctttccaaagggcaggcgctcacctcttttttgtaacctcttacagcttcctcagctcagcttgctctgcacagagcaggtgctccataaatggcaattactgatggcatgcctgactccatatcgaggttattaaacattatgccactttcatttagtcagttatataagtttattttatttatttatttatttatttatttatttatttatttatttattttgagacggagtctcactctgtcgcccaggctagagtgcagtggcaccatctcggctcactgcaacctccgcctcccaggttcaagcagttctcgtgcctcagcctcccgagtacctgggactacaggcatgcgccaccacgcccggctaatttttgtatttttagcagagacggggtttcaccgtcttggccaggctggtctcgaactcctgacttcaggtgatccacccgcctctgcctcccaaagtgttgggattacagacgtgagccactgtgcccagccaagtttaaacttccatagtgtccccatgtgtaaatatagcatctctcaaaaccaccagaaagcagattgctgatagccctgccgtcttttcacaaaactaaatattttgatttctgtcataatcacaccggctctgtgaacctcagagcctttagctcttagaaggtagcggccagtttccgcattcttactattcttaaagtttaagggcccagccatcttcttttcctttagaacatattttaagatactttggagatactttggttccaaatgactccctttcgcaaagtcttggctttttaagtcattttgctccttgaagcctgatcaccactggggacaacagtgattgcgttcttggagaaaatggaaaggtttttaaaaaaattatgttaggaaaagggaaaaacaatctcattctgcttccgagtgtgtttattttgtacctttacatatgtaaatgacagattttttttttttttccctgtaagcagtagtttttctgctacaaggtgtcaccaagaattagaccaacctgtttggagaaagggatcaactattcagaattaaaggggaagagaaaaatttagttgagggtaaagatatctaacttggcttattgcatcttgaccagtttttaaatttaaagaaagaattggtccaggcactgtggctaatgcctgtaatcccagcattttgagaggctgaggcaggaggatcgcttgagtccaggagtttgagaccagctcgggcaacacagtgagacccctgtctctacaaaaaaataaaaaaattatccaggcatagtggtgcacccctgtggtcccggctacatgggaagctgagatgggaggatcgcttgagcctgggaagttgaggctgcagtgagctgggatcgcgtcactgcactccagcctggacaatagagcaagaccatgtctcaaaaaaagaaggagggagggaagtagaaagggaaggaaagaagggaggaaaggtagaagacggaaggaggaaaggaaggaaagaagggaggaagtgagggctttttgggcctttaagatctgataaggctgcattttaacatggcgtggtttatctggctctggggcagctctcaggcaccaaagtcatggctttggcctcactgtctttgtagcacttatgttttgtgtgcttttgaaagtggagacagctgcagttactgatctattgatggttgggtggtttcctcccattaagcttttggaaaattgatcagactgttggcaaggtttgggaaaccttggttttgttactggatggaatctgaaaatatcactgctttttcttttcctgtatatgtataggcattccattattttacttccatggtaatctgattttagagttgggcaaatccttttattttaggaataccctggtctaagaatgtcaacctatagcctgagggctggccacctgtttttttttttctaattaatagactgttttttaaaaagagtacagttcgtcctccatatctgtgggttccacatccatggattcaatcaacctcagatagaaaatattcagaaaaaaaattccacaaatttccaaaaagcaaaatttgaatttgcctcaccttgaacactatgttgaatccatgtaaatgaaatgatgtgtaggccttgtaactagtctagagataatttaaagtatatggaaggatgtgcataggtcatatgcaaatactctaggccattttatgtaagagactcgagtatccatggattttgatatccaagggtgtccaggaaccaatcccccacagatactgagaggcagttttaggtttacagcaaaattgagcggaagtacagagtgcccacagaacccctccccacccccaaacacagtctctgccgccatcagtatcctgcaccagtgtgggacatttgttataattgatgaaccagcattgacccatcattatcacctaaagtccatagtttacattagggctcattctttgtgttgcacactgcgggttttgacaactcctgtttttgtaaataaagttttactggaacacagccatgctcattcatcacatattgtttgtggcttttgtccatccacaacagcagaaattgagtattgacagagactatatggcccacaaagccaaaaatgtttactatctggtcccgtacagaaagtttcttgttccctgttctaagacaaatcagttccctctttaaagaactgagcagtgattggtcttaatttccatttaagtggtaaagctctgtttctcctgtatgctagtaacaataaactttgactatctggagtgtgacttttggggtagtgaaggcttttccaggtaatcgggtggtttacctataggatatctgcctcagagtggaattaccatatgaaagctgttgacagtttataggtttaatttatccagggctgtcagcaaagtttatctgtatcagtttctccgtagccctgccaaaatgaggttttatgattttaatcgcatcataggtaacataggaatgaaaagtgctttttcctctgcttgggttttttgtctgctttttgttctgtgtaaagtgccattggccattttgtaaccagaatctgaagtttttatcatttgcataaattcctgtgtatatttggcatagtaagctcttgtgctgtgtaaatatcgtttcctttggcaaagtaattatcaaagtataaaactgaagacatttggaaagaattgctatattacctgtaatatgggtaattcatctgtttttttgtgatagcccttcctgcttttgcccatatatttacatgtgttaacactgtatgttggtttcctttttatctagtgcacagtctgagttttcatatgctcagtgttacctatatcatttacggtgcttttatcatggtcagatttgtcacctatagcagagtttgtaagtagttattaaatctctctggaatctattgccattttctgatgagcctttgtagctaactcatttttaccctgttctgctgtcaagttgcccaacaattattaagacctcaagtttttctcttgaaacttggctgtttctcttttatcttggccgtttctctttgatcatatgctaagctctcagagtagtttgtatttgtggattctagtcaacatggcaacttttctgattttaactaaatatcacattttaactttgtaatttatgttgaaatttggtgagggcagttccttatttattactttacattttaaataattcttgcttttcttgtgtactaattcttcttgataaattagtcattgtgcaccttgaatagcatatcatcaaaagtgtgctaagggaactgtggatgggttacgtggtgttttagggtttacatctttgccatgtacttggcattgaaactggcattgaggccgggcatggtggctcatgcctgtaatctcagcactttgggaggacaaggtgggtgaatcacttgaggtcaggagttcgagaccagcctggccaacatggtgaaaccccatatctactaaaaaaaaatacaatacaatacaaaaaatcagctgggagtggtggctcatatctgtagtcccagctactcaggaggctgaggcaggagaatcgtttgaacctgggaggtggaggttgcagtgagccgagatcgtgccactgcactccagcctgggtgatagaatgagactctgtcacaaacaaacaaacaaaggaaaaactagcactgaagtatcttcagttagcctatttcgcttttatggcaggaaggctagtttacgctatacttgccttcgtgggagagctgggtttgattgtgacccatggtggatgtccttcatatccctcaaggagaaccccattcctggtcattgcctcatcttaactctgagattaaaccttttgccataatgaatggcagaaaaattgtagtaaactattacatttgcacaggtcagcatttatattcgctctaattgaatacttagggttctaactcagtggtatgttatttccctaagggtcacctaaacagttgtgattttattttcattcttggacttgatctatgattctccttaaccatttgagttgtaccagtgttgctttctctcttaccagggcatggaggtcagtatataatagtctcactgttgggaagaaattatcatctctctaacattttcccataccatgaagttaaatattttgccatgtgttgctggccagaaaacagtagggccttttgaaatttgtaacttacatatattttcccacaattgttacattttcatagaccagagaacactcaggcttctatctgaaccttttcttggatctgtcctagtagggtataatgtttccttaagcttgctagcagatatttcttaataccagcctgtggattttgtataactttggttaatttctcctcctgattctgctgttaaatagaaagcaaagtggttattgctgtattactgttcctgcattggtcatgtgatgtgctcatgtgagcactttatttgtaatagactcttctgggaggaagctgcttgtctcagggagtctcctgttctctagaaattgcccttcatggccagggtactgcttcttttgttagagctccttacatattctctaccgtgttatctctggcctacatactcctattcctgtttctttgacctgagcttgacttcagtgaagctattggagaaggaaattaaaatggactcttggctgggcacagtgactcacacctataatcccaacactttgggaggccgaggcaggcagatcacctgagatcagcagtttgagaccagtctggcaaacatggtgaaaccccatctctaataaaatacaaaaaaaaattagccaggcggtggcacgtgcctgtaatcccagcaacttaggaggctgaggcaggagaatcgcttgaaccagggaggcagaggttgcagtgaaccgaggtcgcgccactgcactccagcttgggcgatggagtgagactccgtctcaaaaaaaacaaacaaaaaaaaaaggactttatatggcacctgaaaaagattcaatagattcgactagcacttactgagtacttaccaactaaaacaggatatcatctaattctcacaacagccatgcccattttaccaattaggaaactgaagttctgagcgggtaagaagatgactcacacgtataataggtagtagagccacatgtctgcccgcctgatcgtcttaccacctctttatagcagagaaagtaggtgagggattgggcgcagtgtgtgagcaaaacaaactggaggaaaggaccatcgagtgcattgtcaccgcctcccaagcattaccacatcctgaagcacagccgtttccttctcgagtttgtttagtttttatcttccccatttaagatcatctgaaagtgaaagggaaaaaaagagctgacactgaaaagtctcttacagagtacaaagatgtttgtgatcagtttcccaagaggctgaaataaaactcaaaggtgaaaataaagacaacagtacatgggtaaataaaaaattggggatgcttaatagccattgtctgggcttgaggagttctttgatttgtttaccctcattgaattttctatgattagatgctagtccatggttctcagtcctggctgctcatgagaattgtctggggagcgcctgaaatgagtgacacctgctccctacataaaccaattaaatcaattgctgcgggtaggagtctaggtgctggtgcttttgggttacccaggcgattgtgtaataatattcttccagagttaaaaccacagtgttagagctggtgaaatttttgcccaagagctatgaaccactttaggggatagagtctgtgagtgagatgccaaaggttaacaccgaagtcattctggagtccatcagcattagttgaaagttctggatttggaatgaaatggaaactaagaagcattgggaaattgccaaggcatattcattgcctttgaggagctcatagataaatgagaagctgggacaaatacataaatttacgtatgctagtcagaaggatgaatcatataattttgtggtatctttttgctgctgtccctacctcgcccttaaaggtttttgaaataagggtggtttctgggaacaggtaaggtgttaacccaattgtcctttatccaaaatgttgttggaggctttctggatggagatcacaaagagaagaacaaaatgtaaatgtgcatactctttttctttttcttttttttttttttgacaaagtcttgctctgtcgcccaggctggagtggagtggcgcgatcttggctcactgcaagctccgccttccgggttcacgccattctcctgcctcagcctccccagtagctgggactgcaggcgcccgccactgcacgcggctaattttttgtatttttagtagagacagggtttcaccgtggtctcgatctcctgacctcgtgatctgcccgcctcggcctcccaaagtgctgggattacaggcgtgagccaccgcgcctggcccctttttcttgacttccaccttttttccttggctgtttactcctagcactgctctccagagttttcttagaatttatattagtaggcaaggttagtgtatgataaataactgtatagagagacaaacaaaaatcttatcctcttagactaattcagtgggaacttgagcttagagactgatgtggtttggctctgtgtctccacccaaatctcatgttgagttatgattttcagtgttggtggtggggcctggtgggaggtgattggatcatgggggcagatttcccccttgctgttctcatgatagcgagtgagttctcatgagatctggttgtttaaaagtgtgtagcacttctccctttgctctctctctctcctgccaccatgtgaagatgtgcttgcttccccttcgcctctgccatgattgtaagtttcctgaggcctccctatccatgtggactgtgagtcaattaaacctctttccttcataagttactcagtctcaggtagttctttctagccacatgagaacaaactaatacagagatcatctgtaatcttcccaattttacacatgagaaagtagaagccccaagtaaggaagagactatgccagtcatcagctagtttttggtataacatcttggccacctcttccaaagggaaccagaaattattctttttatgaggccaagggaacttacatttgtgtgccactctctgctaaacacaatagtggttagctgtaattctcacagcgtccacattaagtgtttccatttcttggatgaagagtctaaagcttagatagtttaagtctcttacctaagcaaagttaggggcaaagccatggttaaaattcaggtagagtgaggtttgtttgtttgtttattttttggagacagagtgttcctctgtcgtccaggctggagtgcgtggtgtgatcttggctcactgcaacctccacctccaggttcaagtgattctcctgccttagcctcccaagtatctgggataacaggcacccatcaccacgcctggctaattttttgtatttttagtagaaatggggtttcaccatgttgtccaagctggtctcgaactcctgacctcaagtaatctgcccgccttggcctctcaaagtgctgggattacaagcaagattgagcttttaaacctacgctcttttcagtttaacatagtataccattgtccccagtgcaattctttatagcaaatatagtctctattagcaatgctgaggttttgtctaaatttattctgttacacaatcaggaaatggtataatctaatgcttatctagttttattatttcagaactatcagattgatacctactccacttacttacaatgaaataattctacttctgaaaaccactacttgttagtctgcattatcatctctgggaatatgagaagcagtatatacagacttgtactccagtcttaatttctgatgcctaccagcagtgtgagcctgggcaaatcacttaatcccactacacttcagtgtccttatctacaaaatagaaatgctagtggctaatcataggatggttgcattgatgagattgagaacgtatggcatagtgcataacacatggtaggtgcttggtagatgttggttatgaatttactatgagaagttagtgacacagcatttccttgatgaagtcagctttctgctaagaataaaagctgggtagggagctcttaaccttgaatgttaattatcttcaagtttattggctgaaggtctcagctgtacaaaactgatcattttccaagaaacatagcactttcagctcttttgtgctttgagagtgacttgctttggattccctttgatcactgtgatggctaactaaatgatttgcctcagttaacctcaaatatgagtacagtgtgaccattagctattcctgcttccatgacaacagggcatcctgtaactcaccaatttaccgttaggactagattctaaactcccttctggaattaggttgatatggatgcatggcggctttggctgcatagtgcttgttactcacatgctctagctcgtcacagctttatttgtgacatctgttctgaacacatcatgtctcttccactctctggcctgacacaccatattgactgttactgccactgtattgtcttcctacctgccttttggctcttctcatgattttaaggattgaatacccttaaacaaatatatagaatgaagttggcctgtaagagggatttaccgttacctgcaaatgttatcttgaacctctgaattttatttgctatgttaagtttgtaactaaacttactgggtgttttaattttcagttgcgatccgaggtttttttgtgtgtgtgtatgtgacacaggctctcactctgtcacctaggctggagtgcagtggcgcaatcttggctctctgcagccttgacctcctgggctcaagcgatccttgcacctctcagcctccgagtacctgggactacaggtgcacactgccacatccggctaatttgtatattttttgtagagacggggtttcaccatatggcccaggctggtctcgaactcctgagctcaagtgatcctcccgccccggcctaccactgggattacaggtgtgagccaccgcacccagccaggaaattttttgttgttgttgaggcaaagtctcactgtgtcgcccaggctggagtgcagtggcacgatctcggctcactgcaacctccacctcccaggttcaagcgattttcatgcctcagcctcccaagtagctgggactacaggcacgtgccaccatagctggctaatttgtttgtatttttagtagagatggggtttcgccatgttgcccaggctgatctcgaacatctgagctcaagtgatcctcccaccttggcttcccactgggattacaggtgtgagccaccatgcccagccaggaaatatttattgaatacctacaatgtaccaggtattgtactaatggactcttcaatcttttgaggaatcatgatacaggacatagaactcatagaactcagtgactgaggcagtggcagagggcattgcccaagcacagggcacaacttctgggcccacagagaaatccattcacagcttgctttggctttgttatacagagcagcagttttctcactagtctgtgcagatatatgtttcaaaagagcaaacaaacaggatttctaaagagaggggatcaagggactactaccttaattaagaactctatcccaatcaccttcgtacccccttttcctatcagaagaacaaaaatcattacatgaagggtaccacgggtgtcagaccccattaggaagctctgcatatagtagcatattttgtatgagatttttgtatttttttaaagaatagaatagttctagttataggaagatttttatgagttactttgccgtatttgctttatttttccctctccatccatccctattcctctctctctctctctctctcacatacacatgctttatgcttttttgctgaaccatttgagaataaattgcagacatcatgcctctttacccctagatacttaagtatgtatgtcctcagcttaagggtattctcctaataaccatgatacagttattacccttggggaatttatcattgatataaaaataaaatggaacatctaaatttcccttaatggggccaggcgctatggctcacacctgtaatcccagcactttgagaggctcaggctggtggatcacctgaggtcagcagttcgagaccagcctggccaacatggtgaaaccctgtgtctactaaaaatacaaaaattagccaggcgcggtggtgcacatctgtaatcccagctactcgggaggctgaaataggagaatctcttgaacctgggaggcggaggttgcagtgagctgggatcgtgcctctgcactccagcctgggcgacagagcaagactccatctcaaaaaagtaaaacaaaaaaataaataaataaatttcttgtaatggctgccagttcctatattggacagttctcaggtctagaacactctcagaaggcactgtagcagaggagggtgctgagcatagtgcagcagagcccggggtggggggataggggactcctacctcagcaacgcagcagaccagtagcgggcaggagtggcaggaaggctggctgggtgccaacaggagaatgaactaaaagtctgcagacagaagggccaccctctgttctgacctctagaacattaacagcaggcagttatccctatcggcaaggtaaaggacaaaagggggttcttctctaaagacactgatggaactatttcaggagaatcagggaagctggtgtggtattagcgcccactgaaaagccccagtgtaatcaggaattcagggagctctctccgccaagagccccacagggctcccagtctttagcctgcttccttcccaaacctgactgaacaaccaaagatcaccacacgtctgagggaagcctacagcgagaaagagactaacaaagacagaaaaatggacattaacccccaaaagagacaaaatctgactggccataaaagagtgctttaaaatataatttagcaataaatcatctacaaccccccattaacatcccagagaagatcgcattttccaaagatggccatgaggatacttttctacagtgtgaccttggcacccctctgtcaggagcaggagtcgaaatttccttctggagtctgggcaggccctggctacttagcctaattgattgtggcagactaggccagctgtgtgacttctgagcctgggtcataaaaggccatgcggctgctgtcttttcactgaagtggtggaaggatccaactagcccgaagctgccgtgatgtgagggagcccaggaagaggccaccccaagctgctcagatgggcagtcctagttgtgcagttgtctgtcccaagcatcagacttaggagtgaaggggccctcggatgtttccagacccaagatctagtcaccctgcagccttcgggttttcccagctgaagcccagataagccatcccttctgcgtgctgtctaaattcctgactcacagcatctgtgagtatcataatatggactttggactgaaagaagtcgtgtaatatctagatgttttggggcactgaatttgatagggaataaagtgtgcgtgaaatccccagtatttggctctttgtctctgaagttctgactcactctttttgtttttgtttttttgaaatggggtgtcactctgtcacctgggctggagtgcagtggcacaatcacagctcactgcagcctcgacctcctggctcaagcgatcctcctgcctcagtctcctaagtagctggaactatagtcacgcaccaccatgcccagatgattttttatttttttgtggagactgggtctccctatgttgcctgggctggtcttgaactcttggactcaagcagtcctcttgcctcagcctcccaaagtgctgggattacaggcataattggctcactgttattaataaccaaaacatggtctggcctagagtggaggcagccccaagtttggcagattccaaatctgcagcctattttgatccttcttaaattcagaaataaatgttcttgaacaaaggaaaactcttaagctcttaaggcagtgagaaactgctcatgaaacaaaacaaacattttaaaagtagaaactaagtttttaaaaaagtgattctttgaaggacattcacaaccatttggtaggtctccattcacatgtcagattgtttcttctgaaggactattcaattaatcattgtttaaccctagtaaatcaaaaaattaatgacttattctaaaattcagtgttttcaacagattgaaatcttataactacaactagagaaaagaagttgaagagctcacctgcacacatggacataaacatggggacaacagacactgtaaactactagacggagggggaagtgggcgcgggttgaaaaactacctattgggtactgtgcacactgcctaggtgcaacatacacatggaacaaacctgcgcatgtaccccctgtatctgaaataaaagttgaaaattttttttaaaaagcttaaaataatatgttctcagttatattttaccaatttaaacatggctaatgggaaaagtacattgccaactcagacatttagttggtgatattaatcgaaagcatttagttgatgatattaataaaaattatcagaatgagctggatcattctgttggggttttttggtgccttgcgggtaatttttccatgtattgctctttatctcattattgccactcccaaaccaccccccaacccccaccaactgctaaagctgaacaatggacaaagaaagccttcaagtaatccagacagaggagactctacattttaggaggcatggtctctgttgattgaagacagtacaaaatatgtcctcagcctctgctttaattaaaaggtacttactatcaatcacttgaacctaggaggcggaggtggcagtgagccaagattgtgccattgcactccagcctgggcaacaagagcaaaactccatctcaaaaaaaaaaaaaaaaaaaaaaaaaagacacttattatcaggtgacttgattaattgaagaaataattattttttctgccgcctgtaaattagtcgaaaagaggattaaaacgaagccagggttatcagccactatgtaaaccaggtataaagaaatatgtctgtgagctcctgctctcaggtggctagctaaacgctcttggctacctcctggtcccaccatagggaaggctccctgcattacattgaaagtcatttatatttctgtgtctattcaccctaggtcttggtgaatgtgaagctatatggaacctttctagacaaagcaaatcataccttttgcaaatatagtaattgtctccagcttcccaataaaaggacaaagtataaaaaacaaacagaggccaggcgcagtggctcacgcctgtaatcctagaactttgggaagctgaggcaggcggatcatctgaggtcaggagttcgagaccaacctggccaacatggtgaaaccccgtctctactaaaaatacaaaaattagccgggtgtggtggtgcatgcctgtaatcccagctactcaggaggctgaggcaggagaatcgcttgaactcaggaggtggaggttgccgccacttggtgagccaagattgcgccactgcactccagcctgggcaacagagagagactctgtctcaaaaacaaacaaacaaaccagaaacaaaggagaatgaaaggatcgtcaaacttaggagaaaaacagaagaaatgcacatgagtgtatttgagtctaatgacctgtttgcatccactaagtcagagttttccaagccccctcacctgctccctttgtcatctttgaactgataccagggaaaaacttaattggtaaatttgaataagatgaagtatattgagaaatgcagaataaaaatagaaagtcaaaattaaggaatgtagagaagccaagtaagtagggaaaaaatgaagtcaaataattggaaagcagaactggaaaatacacaatataccagaagacttatcaaaacagaaccctctggcgaggacattcatttaaaaccaaaatgtttttcttggtaagtttattatttaaaaaaaaatggttgttagaaccttttcatttaaactgagtatccggcattaatacataggaaagatactttcaatgtacgtgaagaaagcacagaaaggttataaaaatcaggcatttcatacttatttttaggctaactaattaactaaaaaagacttatcctcctatttaagctgatatataattaaggtgtctgagtacaaagaatttgtccctaaacctaatgtagaatgtaagagacaaaacctgaaattttccaactactctttttaaaaaatacgaacttctggactgagtgtggtggctcatgcctgtcatcccagcactttgggaggctgaggcgggcaggtcacttaaggtcaggagttggagaccagctagtccaacatggtgaaacctcatctctactaaaaatacaaaaattagctgggcgtggtgatgggcacctgtaatcccagctactcaggaggctgaggcaggagaatcgtttgaacccaggaggcgtaggttgcagtgagccgagatcacaccactgcacttcagcctgggcaacagagtgggactctgtctcaaaaaaaaaaaaaaaaaagaaaaaaaaagaaatcaacaacaaacaaagaaaaaaacaaacttctgaaagcattatctattatttgaaaaaatcattgagaagctaccataggcgaggcactataatatgtgctatgggggatagagagacagataaaagtttctttccacatgagttttataacaggctgataatccaaggaagcttgaagaaaatgcttcctgaaatttggttctcttagaccatgcctagtagttgagttttaactattgcagaatcatcagatgagcccagggaatgggttctcagggctgaccaagcagtaactgacagttcgattgtgtatcccatggcctcagactattctgtttgagcatcatcagcgtcattagtgattgctatttaattagcccctcttctaagttttaagaatatgtgactgttaaatattgtggtttattaagtttttatttatagagatgggggtcttgccacattgcccaggctggtctcgaactcctggcctcacatgatcttcccatctcagcctcccaagtagctaggattacgggcgtgagccactgcctctggtttaaatgttaagcacatgttaaccctcaccaaatctctgtgaagtagatactgctctttttttataggtggttacaatgaagtttagaagtgtaaagaaacttacccctgctcatgaagcttgtgaatgctctagtcaagattcaaaccctgacctttgtcatcgaacttcagcacctgacctttgtcatcaacgccccgcaggaccataagcttttctctgaatcctgaactcaaaaaactctgaaaattgaatttctttttcatatatttgctgccacaactcattttgtggcaaaaccagacctgaactgacttgattccatagtccttatcctacttactggaaatgttcacgtatttcactgcagctatgttgtggctctctaatactctgtattgtacaatgtatggtatagactcctttttaccttcctaaaattgaaaaacctttaaattctgaaaccatctagatctgcaacttctagagaagagatgagaagctgactatggccacctcacacctgccagccagctctcactgctcacaacatgctcgtatcctgtgactcctaacaggctgccaacttggaaatttaaacatgtatactttcattaccctcaaaaactcataattgtgaaaaaattattagttcatactgatactaccagtttcagtttaacaccagaattcttctacttcttccctattccagaacttcctttttcctcttaaagaaaaaaaaaaactggctagacatggttggtggctcacacctgtaatcccaacagtttgggaggccgaggtgggcggatcacctgaggtcaggagttcaagaccagcctggccaacatggtgaaaccctatctctttgtaaaaatacaaaaattagccgggcatggtggcggatgcctttaatcccagctactccagaggctgaggcagggagaattgcttgaactcgggaggtggaggttgggtgacagagcgagaccctgtctcaaaaaaaaaaaaaaagaaaaaagaaaaaaaaattatctgatacttgttaaagatggtagggaaggctttattcaagagggaccactacagtgggagttttgcaatagtggggagagatcaggttgaactcctaatgcaacaaggacaagtggaaatttatagccaaggagcagagtgtgggtcaatgggtggaaagttactaagaggaaaaatccaggttggaggggattcttgttgaaggcaggccagcatgataagatatcgagggtagggggatcagacaccaagggtaggggattttcactaaaatgactcagcaggatttttgctgagactggactaagcaggtcaagatagaacccaaagtcgaggcctagtcagaaagaggactcagagccgggcacggtggctcatgcctgtaatcccagcactttgggaggctgagacgggaggatcgcttgagcccaggagttcgagaccagcctgggcaacatggcgaaaccccctctttactaaaaatacaaaaattagccagctgtcccacctacctgggaggctgaggtggcaggatcacttgagcccaggaggttgaggtggtagtaaaccgtgattgtaccactgcactgcagcctgggtgacagagtgagaccctgtctccaaaagcaaacaaacccagaagaaccggtttcaagtttggtcaaaggagagagtctttgtcatcccacagtgagaacatcaatgtttcttttgtgatttaaagataatttcctttctgtttagccaggatgcaaagtatttttcctggcatgtgaaaagctagacttttattttaacttagataatagggaattcattttataatgagattcactgtgataaatatcagcaattttattgcatttaaaattaaaattatattcatccagaaccttttaggaataatatacagatgctccttgacttacagtggggttacatcctgatgaatccatcataagtcgaaaatattgtaactcaaaaatgcacttggccaggcacagtggctcatgcctgtaatgccagcactttgggaggccaaggtgggtggatcacttgaggtcaggagttcgagaccagcctggccaacatgatgaaaccctatctctactgaaaacacaaaaattagccaagcattgtgacgggcgcctgtaatcccagctactcgggaggctgaggcacgagagccgcttgaacctggggggtggaggttgcagtaagcggagatcatgccactgcactccagcctgggtgacagtgagattctgtctcaaaacaaaaaagcccttaataattagataaacccatcataaagtgagaagattaaacaatcaaaaaatcataagttgaactgttttaagttggggactgtctctatattatttgaagcaaaatgaccagagctggctgggcgcggtggctcatgcctgtaatcccagcactttgggaggccgaggcgggtggatcacgagtcaggagatggagaccatcctggctaacacagtgaaaccccgtctctactaaaaatacgaaaaattagccaggcgtggtggtgggtgcctgtagtcccagctacttgggaggccgaggcaggagaatcacttgaacccaggaggcggaggttgcagtgagtcgagatcatgccattgcactccagcctgggcgacagagcaacactccgtcaaaaaaaaaaaaaaaatgaccagagtcattttaaatgttaattgcctaaggccaaatgaatgtgtatagaatagatgttggaaggtcattgtgggggcattacaccccttctcctcttacttgaagtgggtatttggggattgaggtacttatcacagtgaaagtatgaaggagaaaagtgaatcatcatttagttaaaagatttaccaaaggccttcaatatactcacttaggatgagggaaatgagggatggattatttcagactttcatcttttattgtaacttttttgagaatggagaagggggtcagggatgagtggggaagaaaggttctgcagattactttctagattaggttctttttttcaagttttatttggtagggagagcaaatgaataaaccagaatatgactggaagtgttagaaaattggattcacttctgaatctctgacttgctgccttcatgacgtacagaagaataaggagagtttggaagagaaaattgttaaatggctctgctcgtctctctctgggcctggccatgatgttgcccatttctgtgcagcctccagggaatatggagcagcaaagaggcctaggcagggcgagggagatgggatggacccctcaataccacggagaccggaaggaccagtgtttgtccaacacttgctccgtgtcagcctccatgcacagtatcacatttagtccttacacaaactagttttatccccattttacagattaaggcagctgagactcagaagtgaagaagcttaccaaaggtttcacaacctgcaaatggaggagttggggctggagaacatttctgtctccaaagctcatgccttttctatcaggccctccactcccagccaccatggagtttccagcagggctgggggttgcaggccaggctgatgctagaactcttcctgccacatgacagcaggggaaagagctcaggtttcctcttttaagtggccaggtatgtttcctctcatggcgtcttgtttatgtaaattttatgcacagctagctcagggaagcctccagaaggcactgacctccttccttatggtcaacccacatcttaccctctccgatgtggcatggtagatcactctgcctctgagtatacccaggagatagtttctctggcatgtttctctggcacatgccaaccctgtgtctcagtcagagcccctcctctggaagcacagggtctctggggtctgtggctacttcccagaggggcagagctatggtccctgaagaaacacactggaggaaaatcttaggaaacagttggcacacacagtaggtaaataattgtgaaatgaatggatccgttgcctcctggaaagccctatgaatgggagtggatttacacgttctgttacctttgtacttggcagttttcccatggtgtttatttgaaaacaagttcagattatatcccaggtcacttttgtattgccgctggtaacactaggaacgtttttgtgttaagaaaaaaaaactgctttcaaagttgcctcttgtaatgaatgttctttttctctgctaattaacttattttcttgaacttgctatttcaaaggataaaaattcaactagagactgcaggattatttaattttctctttccaaccagtagtaaccgtgctaccgtgggagcactttatttctccatctgttagactataaaatcatggaacatttttcatgtcttaatagggagagataatgcatgtgagaaaacttcatatatgtttctacgaaaggaacttcctgtgcggctggctaacacaatgagagaagttaatcttctgccggataatttacttaaccgcccttcagtgggattggttcagagttggtaagtaaacaatgtggcttaaaatggatcttcccacaatgctgtgaacatttggcagcgagaccattctctgtaaaagtgcacatactgcccgtctaggtaggaatgagtcatttgggatagctgggttttccatgcaattaaaagttgttttgttttttttcttttagagctgtttgttttaaagttgttttagtgaaaatgcttgttaagttatactagacactttcctgagtttttcttgtgtgtggtgggattgcagttcttctgacaggatatttgctgcttttatcaagtcttaaccttactcctttcgttttccttgtaaagacattccttgaagtcagtacttcttgtagaacaaattaagtcatttaaaggggaacctcagattggaaaaatatcagttccctcctttgcttcatttgctccatgaaaagtaggaaaaattttgacagagtataacataaacttaaatcagttatagctctgatgcttaaagcatatgtcatttaactgaagaagttgaatttgtgacacaaagtcctgggccacccgtgcttttgactgagtggctagacattgagtttccatgccccttttctcagatttgataatttgctagaacggctcacagaactcaggaagatacttcacctatgtttataggtttattagaaagggtacaattcaggaacagccacatgggagagatgcatagggcaaggtatggggggacacatggagcttccatgcccactctgggcacaccaccctcccagtacccccatatgttcaccaacctggagactctctgatggtcgttcaagggttttgatagagctcaatctccagccctctcccctccccagaggttgagggtagagctgaaagttgcagtcctcgaatcacttggcctttctggtgaccagccccatcctgaggctatctagaggtcccgtcctaagtcaccacattagcataaactcaggtgtggtcaaaggcggctccttatggatagcagaagacaatcctatcattcaggtagttccaagggttttgggagctctgtccaggaagcagggacaaagaccaaatgtacttaaatgtgttatattattccggcaaagtataggcttgaacaaattgctatgtcaactctattgtttggtttttgtcttttaactgttccttttccgtatccattccaaacaaatgcatgccatttcttccttcttgtttcttaaacattctattttgaaatactttcctacttaacagaagggttgtaaaactggtagaaagaattccagtataccttcacgtagattcactaattgttaacattgttaacatttggcaacgttctaccattgtcattcagattctctctctctgtctcactctctgcatacacacacacacacacacacacacgtgcgtgcacacatatatataatctatgtctatatatggtacacacacccatatatggtacacatacacgatgtctacatcatgcccctttgccctaaatactttagcatgtatttcattggaacaggtctcagaaaaccacaatgtgatcatcaaatttgggaaatttaacattgatacagtaatgtcttctaatatgtagaacttgttctcactttactactaattgtcctgatactacccccatctttttttttttttttttttttttgcagtttctcctcctgatttaggaatccacttcaggatcatgcattgtgtttcactgccattttttccttttaaaagcgaatcttatgcataatgggctgtgacccccaccaccatccccttggtcacagtgtgtcctccttgctctcttgactgtcaggctgggaacctcaaaataatcttttttttttttttttttttttttttttgagacagagtctctctctgttgccgaggctggagtgcagtggcgggatctcagctcactgcaagctccgcctcctgggttcatgccattctcctgtctcaacctcccaagtagctgggactacaggcgcccgccaccatgccctgctaatttttgtatttttagtaaagacggggtttcactgtgttagccaggttggtctcgatctcctgaccttgtgatccgcctgcctcggcctctcaaagtgctgggattacaggtgtgagccaccgcacctggcccagaataatctttggctccctgctatttatgactttctccaactgtcccctttggaaaggacgggatgcctacctagcttgcttgcatgtggcagggcggagggcatcactggggctggctggctttgacctcttggcgttttgacccaatgattttaacaatatctaatccatagccttatatgcccagagacttttatttatttattttatttatttttttgagatggagtcttgctcagtcgcccaggctggaatgcagtggcacaacctcggctcactgcaacttctgcctcctgggttcaagcgattctcctgcctcagcctcccgagtagctaggactacaggcatgtgccaccacgcccagctaattttttgtatttttagtagagacggggtttcgccatgttggccaggctggtcttgaactcctggcctcaagtaatccactcgcctcagcctcccgaagtgctgggattacaggcgtgagctaacacgcccagcccccagagacttttaaaaagtatgtccatcaatgaacattcattagtatcaaatgcattgtccaaagttcacatgaagctgatgaatcaagtggcattctcattggagtatttatatgtgtaacagtcatttttagttactagagtgtcctcatcctctatccaaaggtgtagataataggattagtggcaattaaagcttagaaataattagaataaagggataattctttcaggacatgttaaaaccccaaatagagatcacatatctctaattggaatatctgaatccccaccagatccaacagatcctggctggatatagctgctgcactaatgggcctctctggatctcatttttctgtgttctccagattttaatgttggacagactgtttcttatactggccctgattgagatatggagctattcttaatccagaagctgtttctgagggtttaattggccttctttctcccccattaagtactgatgaaattaatttaactcagaaggacccttcttcacttctagtttctaagttcttggcaggcacttcagtgtcacacatgtgtttcttaaaatgtataagtacatttttggtaatcaaactgtagacttggtatataagttaggatatgtctgtttgtaagtagaaaaaatgcaaccgaacctggctcatgtcactagaaggtccagccgtagggtgagcttttggtgttggtttgattcagagattcatgaagctatcgaggccctgctttcgatggtgctggcttcattttcagactggattcccccctggtggcagaatagctgcagcagttccaggcttccaatccacacagcactgcacaaaagcagagcaggttgatttctctgccaaagtcctctagcgagtcttttctgtcattttactggcctgaattgagacagtatgtccattcctgagccattccctgtgttcaggggaatgcacacagtgataggcttagacctaaactattgggctaatgaataattagtgacaagagaaatagaattgcccagagaaaaatgggaccacccaggatctttggaggcactggcttccctgatgcacttaagccacatgggggatgcggatgggatggagacctgagtgaaattttggagtgttcttaggaagagggagaggaggggtggatgctgggcaggcaactaacatagtaactcttctttttcttttttttttttccttttaggtatatgcagagttttcttgaacttttagaatatgaaaataagagccctgaggatccacaggtcttggataagtaagtatggtaccacttagctgaaagtaaaaatatctaggtaagaaagattttggtaaatgtaattcaagtcattaagactcaaggagtatgaatgtggacaaaagcgttcattttcttaatgagtagtgactcaacattgagttttttttttttaattcgagctaagaatgtaacacaatacaaaagtaataatgacactttcagttttgcttttatgatctaatacttaatacctttacccaaggtgaactgggcagtcactataaacactgcagtaaatgttccatctagtggtagttttaagaatgcagtggcctttttatatacatgaatttatctactcaatcctttacaattaaaaaaaaaatttcaataggatattacatttgagctcaaaaactgtagtggttttattttggagaggcataaaagtatgtttttttatatagcaacctgaattctattgctccctttatgcacagactggcaaattatcatgctgatgagattcatttttatttatcccaggaacactaactctagctgtgagtatgttttcccctccaagagaaattaaatatccctttcacattaatttcttcctgtttcatgtatatgtaagtggatgcatatggtaggcctgttgtgctgagaaatttctaagtataaactagtccacatagttatgagactgaacacctgacttaatagatgttccataagaagaactagggaaacaccatgttatacaagcaaccttaggaggtatttaacccagtcctctcaatccacagataaggaaactgagttcagagatgtgaagtgacttgcccaagattgtgaccgttcatagcaaagctggacctataagctatgtttacgtctgagccatgagtagctagttctagtctagttgtaaactaaaattcaaaggaaaaacaaaagccctcacctattttatactttgttgggtgtttgtctgatggatctgtgaagtgtggaaggcagggaagcattgggttagagccccagatgtagcgttttccttgatataagccactgctgtcatttaagcgattattaaatgaattcaatccaggagctttgttttctcaaaagtcattagctggtaaccgtttggcagaaatcctaaaacctagggctgaccactgtagctccaaattttagaacaaatttgtagaagtatagttggtcctttgtactggcagtttccacatccttggattcaaccagccacagattgaaaagatattcaggaaaaaaaaaagcaataaaaaataacaatgcaacaataagaaataatacaaaattttaaaatacagtctatcaactgtttacatagcatttacattgtatcaggtattataactagtctagagatgatttaaagtatccgagaggatgtgagtaggctgtatgcactattttagataagggacttgagcatctgaggatttgggtatctgcggggatcctggaaccagtcccctgcggatactgagagacgactatacacgatgttaaatttctgctgtgtttttcccggagtcccgtctcagtttctggaacaggttatccgatgtgatttatggccacgagcctgctttgcaaactgtcagtgctgaatccagtgtgtgcttgacgatagcaataatagctgagctctcactccgtgagttttgtagcttgcctaggttcatgtggttagttatgatagttggcatttgagaaggctgatgttcttggtgaaggaaggagtgaaaggtgagcgagtatcatggtagcagccttttctgtttaccaagaggttgtatgggatcaccagcagggaaatcattttagtaaagcaaaagtagcttagaggacaagcttgttgatcatttatgatagagtttagaagagcccggaagattggaggagaattctgagcattgagccattgaggtaagtctccccacttcagataagttgaggcacttctctactataatgaatcgtttcactttagtaatatttaacttacaaatacattgcaacgagtattacataaaggacaaattgtctattataaaattttttgtgaatgacgatggcctaatttcagagttttacatctttattgtcattgtacgtatgtatttgttacagaaatatttcgtcaaatatttcatcaaatatttcagaaaaataagactattgagataagtaaaaagaaagtcaccccaaatttctactaccaggggacaaccactattactattttcctttcttccgtgcttttccctaggcatgcatatatttatatgcgtaaaatatttttacaaacataacaagtgtcaacattatagatctacaccattattaatagtttcataatattcatgttaatagtccatcttcagatagttcatgcaatttgatcttctatcactggattttagactggtttgtagttttcatgctactataaacaatgctttaaagaacagcttttaaatacatctgttggccgggcatggtggccgacgcctgtaatcccagcactttgggaggccaaggcgggcggatcacctgaggccaggagttcgagaccagcctgggcaacatggtgaaaccctgtctctactaaaaatatgaaaattagccaggcgtggtggtgggcacctgtaatcccaggtactttgggaggctgcaggagaattgcctaaacgcgggaggcagaggttgcagtgagtcaagattgtgccactgcactctagcctgggcaacagagcaagactctgtctcataaataaataaacaaacaaacaaacagctgttcaccttttccagttattttcctaggatcaattcctccaagtggaattattttctttgggcttttgctgtatgttgctgattgtcctgagaagtgcctcagttaagccccaaactctagctgatgctgatacgtggagaataataagtatcacattgttttgatttgcttttcttatttgtaagggtgacgttattggcatttgtgcttcttctttggtaaattttgcattgatagcagatcctttgcctagttttctgatggggtgctagttttttcctttttttaagttttttgttttttttctacttcatttattaatgtgtgtccctataggattgctaaaattctacatagtcatatcatttgtttcttcacattatttgtttctacctttgatattaagcttagaacagccctccttatcccaagattatgtacttattcacctgatttttctgttatcatttctgtgatttcacccttttacatttttaatccagtatttggttttaagtcttgaaattaggatgtgactgaaattgttagcccgctgttccagttaacttgattattagtttgattgtttacctactgatttgcaatgtcactttctcaatatgctcgatttttatatatacatactcactcatgggcctggtcctaaactttttatttagttccattgactgacttgtcttataccattcttaatgtattttcccatatgcatatttacaataagatgccagatacttgaatagtttaatttcctgtgttctgtctgcatttcatcactgtattttactgctgcgagatatttatttccaaattttactcttaaactgtatgagacactttaggaggctgaggtgggcggatcacgaggtcaggagttcaagaccagcctggccaatatggtgaaatcctgtctctactaaaaatacaaaaattagccaggcgtggtggcgtacacctgtagtctcagctactcgggaggctgaggcagaagaattgcttgaacccgcgaggtggaggttgcagtgagccgagatcacaccactgcactccagcctgggtgacagagtgagactccgtcaaaagaacaaacaaacaaaacccaaaaaacagtgtgacattatttctttattcatggaagctattgctttgagattgctttaatcagtccttggagattttgtggggattgtcctcatgttctcagaagaagtactgatatgttctgcaattctttattcaacttttatagaacctgtgttatatgcaatcacttatccaaaaagtctggattcctaaaagggtatttgagcattttttttctgtactagaaccttttactttttgcacttctgaaagaagggtttctgtagaaaaaaagtttcaagcaaaaacttggctcatactttagtttcttgtgggtggttccttgttctatgtagtaagaataatgtctctacttataaaaataccagcagacaactagtctggggacagagctgggaagtctgtgcatcagcccatgagatattaagactgaccacgttttgtttccctctcacacagctttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacagtaagttggagtttgttggtccagttttgaaaaggtaaccatagtgatttctcccaaatgttttcctgttgttaatttactgacctgcatttttggttgtagaaatttcatttctagttcggtttttcctaagtgaatcctagccattacaaagctattaatttgtattcttggttaaaagaaatgtttgaaaggcttttatgaggctcacattagagacaggaccactgcctaccttttaagtctctgctgatacagtcttgatggggatgagggaccgcctttaatggcagccggccttcatctctgaatacttttatgtatctcagattgtattattttctttatccaggatattatgtgttttcctttttagttttaaaaacattgacactggaaatattgaattggatgttggtgataggagccatcagttctttatttcacagtgatcagtgaagtcagattaagccagactgtcagtccataatcccgtattgagagttttagtctgctcttgagggtactaagcagatatgaaaaaaacaactaaaattccctccacacaaaaaactttttggctcatcttcagcactgtctctttggctgattttataatccttgaggaaaagcatccacatgtctagagcataattcaccctgtttgctgcatcacaaagtggacaaaccatctttattttagtaatttgatttatttggataactgaatgttatagaactattaaatgtggccttatattaaatgtatatcttcaaaatggaaatgtatgacaatttacaggaataaaagagcctaaatactgttcaactaaactacttagataactccagttgctttctgatctaaatacacatgtacacatatatacgtgcatgtttttagatcattagttaggcctacacatctctgtttttcttccccttaatcagttcgaactttattaattagcctaatgcctgtatttatcatttttcatagtttaaaatatcccctattttatttaggcatccttcttttgttagtcgcaatttttgcttgatttaaaaataagaacacctataaatatttggatgcagattgcttttttctttggggcttcttttggcttttattcagaaacaaaattttgcaaatcttgtatattgtgaaattatctgagtgtatttttaaaaatacttgaacaagtattgtttgtgtacacaacattgaaacataatctccatgggggaggcatctgaaatgctgccagcgaagacactttgcaagcttgtccaaatggtatagaccacatgttctaaatatttaatgaaagttggagtttgtgtctggagtagtactaagaaggtgggtatacttgactaaggatgaaagtaagtttcttcatccatgtcacattgggagaggaagaacggattgggcacctggcacgtgtcactgctttagaacctgctgactgcaactgacagaccttaaaccacatcctcctccttcattgaccaataagagttgttcacccatcaattgtgtgtattccattgctctaagttgctgtggatgctaaaatgatttttacacataagatatcctttctaaacataagcccctatatttccctgtgtgaccatcccagcctgctgtgttttaatcccctccctttccttttgtgttcgtctagcacttctgtttgggggtgacactaatcctgttcatcctaaacacataggaagtatcgatcccacctgtaacgtggcggatgtggtgaaaggtaaggagaccgttgtaatggtatcgatcgtagttcaaattggattgtggtttattggaggcagcttggctatagggttattttgcagtgcagtctgctgattcatcaggtcactctgggcccaagccactggatccagatgaaatgttctttctaggcagttcaggtaggcagttctttctaggcagttcagcataattggtaaggctcaaaatgtgagtttctactttattgattagagtttcatttgtagttctgtctcaaacagtaaacatttaagtaagattctgattgccactgttatctgaaaatttcagagaatccaaattcttatcataaaattaggttgaattcacgtgtctataaaatttaaacatatttctgttgttcacatctggctttagaatttatgtggcatgtaagcttcatgggttcattggactttaagctagacattgttccagtatcctccgggaagaaccaagccctatatccgtaagtccctggtacccaggcactttgaatttgaacagcagtttcctcattatttattcatttaagatcaatgctatctccaagaaaccttcctggttgtgagcgatccaccaggtacctcttcagttttcttcattgttacggttactttgtgcaacctcagatccccaaattgtccctttctgcagattgtatctcctgtgttggcctttatctcccttctttaaacgctcacctcccaagtttcatggctgcaattctctctgatcttcatcaaggatcttcattgctcttcagcagccatagcaaaggaaaacctctgtaatttgtttaccctgggcattcctaaacccagggaggaggaccagacctgttggttttagcttagcctaggattgtctggctgccctggcctctgttgagtcacaacagatttactcacattatttcagttgtaaggtgaatcagcccagcctcagctctaggaatcctattggttgctctctcacaagataactttgtggttgatcagaacctccaaaggcctccgggggcaaggaggaaagggtcagtcttatcatagcttacatgttcattaggccttagctcagtgccttttatgaaacagaaaacttggttcagacagttgattacccctttgagaaaaaggcacaatttagaaagcaaaagtgcattgtgatatatggtatgtgtgcattttctcttgaactgtaaccaatttgaggtcagggtttgtgtcttatatttgttttataacttgcatagaaccaactgtagtgcttgtgtaggtgattaataaatattccttggtttgatacattttaaatcttttgagaatatacttttaaaaacagctttattgagatacaatctcatatgataaacttcaaccatttaaaatgctcaattcagtgttttttagtgtattcacagagttgtgcaaccatcaccacaatccagttgtagaacattttgtttttttctttctttttttttttttttttttttttttttgagacagagtctcgctctgtcgcccaggctggagtgcagtggtacgatctcagctcaccgcaagctctgtccttcgagttcaagtgattctcctgcctcagcctcctgagtagctgggactacaggcgcatgccaccacgcccagctaatttttgtatttttaatagagacggggtttcaccatgttggccaggatggtctcgaactcctgaccttgtgatccacctgccttggcctcccaaagtgctgggattacaggcgtgagctaccacacctggcctgtagaacattttcatcactccagaaagaaaccctggacctgttagcagtcactcccttctacccttctctttagccctagacaaccactaatctactttctgactctgtatagattttcctattatagacatttcatataaacaaaacaatacaatatgtggtctttggtaactggcttctttcactcagcataacattttcaagggtcattgatgtcatagcatctttcagtactttattcctttttatggctgaaaaatattccattgtatgaatataacacattttatttttctcttcatgttagttgggtgatctcagacttgattaagtaacctctttggggctcagattcttcatctgtaaaatgatgctcttggtaattcacctatattgtagagttaaatgagttcatatttgtagaacccctaaagcaatgctagtacacagtaaaggctgtagacaggtttactagcagcagacagtccttgggtgtcagacatgtcatttggcttcccatgtacgccattgattatataataggttggtgcctttattttgtttctggcataaattataaaatattttttaaagtcatttcaggcttttataagacaattggaaatttgaacactggatatttgacattaaaaatatgttaactttttaggtgtgatattggtatctggtcttgtttttataaaggagtgctagctttgagagaggtatttaaaaatatttacacatgatatgaaatgatgtgagatttgcttcaaaattatacacagggaggggagtgaaaaggactgggcatttgttgaaaattcttgaggctgttgatgggcacatgggctcattatactatgctctgtacttgggtatgtgtttggaattcttcacggtaaatgtatgagtctgttctcatgttgctataaagaactacctgaaactgggtaatttatgaagaaaagaggtttgattgactcacagttctgcaggctgtacaagaggcatggcttgggagtcctcaggaaacttacaatcatggcagaagggtgaaggggaagtaagcacgtcttcacttgatggcaggagagagacagcgaaggggaatgtgctacagacttttaaacaaccagatctcgtgggaactcactatcatgagaacagcaaggggaaaatctgcccccatgatccaatcacctcccacaaggccccaccgccaacactcaggatcactattcaacatgagatttgggtgagggtgcagagccaaaccgtatcaatgaagttttaaaaacacttgttttcatcatcttattgtttctgcacaaataaagtctttcactaatttttagggagcttttaaccaagaaccagtacaactagataagtagcagggagttttatgaaactgttaccacttctatagaacagagcgattaagtggtgctaaagtgagtcagaggtgtcagagtgtgaggaggaatcgactgtgatttgactcttaatgtgaacagaatcgatcgttttatggcacttactgtctgtgttactcttctctcatatttagtacatattacctggccttgtcattatttgtactttcttttttttttggagatggagtctcgctctgtcgtccaggctggagtgcaatggcgtgatctcggctcactgcaacctctgcctcctgggttcaagcaattctcctgcctcagcctcccaaatagctgggattacaggcacccaccatcatgcccggctaatttttgtatttttgtagagatgaggccatttgaccagatgttggccatgctggtcttgaactcctgacctcaggtgatccgcccgccttggcctcccaaagtgctgggattacaggcatgagccaccatccccagcctatttgtctctctctatctagggtgtcaatttctaaaggtctggaattattcttatacgcttttgcatcactcctcttagggtcagaagttttgtaccaaaaagtagctgaaggttatatgaagaatagttcaatacataattgaaagaaaaaaccctggaagtttatgccaatgtctacctcatagcttcctctttgctttgtcccttttagacacagttttgaccctgagccacagtcccctcctttttcttccctcttcttgtactcacagctttatctttagtctttctcctgcgcttattaactatattatacccattattgcactgtgaacaaagtttactgcttcccttacttaatcattcctgccactcacttagcataattaaagcttggagttcctggtgaagccctatacaataacagtcacttcttgtgcccttttgtgactcaaaatccctcttcccccaacacacacatacacatacacatgcacacacacacgcatggacatgtacacacatacaaatcccacctccacactcatggggtaagcaggaaggactggcatgctccccattccccacgcctctctcaaaccatggtttttcatctctcaacagcatcctcccttaaggaaaaaaacagtggaggtggtttcagattccgaaagtgtataaccctctaaagcagcagccacataatcaactttctgacatccttcattcccttcataaacgatgcataccgatacccacagcacactaaatactcttggcttatgtgtgttttctggaatgcttttgtacttctgcttccacctggtgaggtgcatgcttactaagggtcacttatttgtacccaagcccttggtgtaagttatactgactgttgtgactatataatttatttaaatgttatgtaaactgaagaaatatgcatacaagaaagagacttatttctgttaaaaccaagttgaatgctttggaaggactcttaaaaatgttatgaaattactgtgagtaagaaaacgattagattacagggcagcacggagtaaaaatcttacctggaatttatacccaggttgcttcacaagtatctttaagtttattatactttaaagaaataggaattggaattcatagatgtaagtgatattgttcatccaagaaagacgaactggaaccccaaactgatccacattcaaaggaaaggccttatatgaatatactgacagataaataaattgtatgttcaaatgtgcattttaagttaatgtttacgatagtaatcacattttacggtttcccactttacccaacatttttgttaatcatccaactccttttcccagttgggatagttaagaagactaatgccattttcccaaaataataaaagtgctcatcgaagaaagtttagaaaatatgggaaaagagagaagagaataaaaattacctgttttcataatttagtgagaacgttgttttatacatttgaactcatatcagatttatagataggtgtgtagctgcaaatattgtgtctaatctttgtctccgtgaaatccatagtatttttgaatttctctatctccagcactaatgcccatcacacacacccttcctggctgaatttgataccccatggtagaagcctctatcctgctgtctgcgtcagtattttggagttcttcctgtgtctaatctgtgatactcattatctgtatatttaaatggtctttccagccaagtgtgcataacctttattctgcagtgggggattggccttacatcagttactttttctaccctggcaaatgggctaggcaacctagaaggaaacctgcaggcctctcttttccttgtagaccaaagcagatgtctccagtcgactgtctgcttcatttcctatggaccctcctcttaattttttgagcatcaaatgcttatgcagaagctctttctacctccaagtaagactgagagagaataaagaaggcacagagcgccaaaggttgaaaggcctgaaatttcttctgtgtcttctagctaaaaggcactggagtctccatccccaaatgccccaggagcaaccatcagaaggtctcaagaggcccaggcctcaccagctcttcttaccaatccctgccaagtgttgccaaggaagggaagaaatggatgtcagcctcttttgactcttagtgaagtcttactgttgccttcctctttttagagtagttggtattttcaccctggctttgtaccttcttccactatcctctgagatttcttagttaatcttctaactcagaatctctatagctaatcttttatttccttccttttgttttaagcagttggatgttacgagagtaagggctccaggttttaatgacagccctactaatgattttcttagctgtgagaatcctacatggtttaagcatagtcagatgtccagcccaaatgaccctgtgtgggcgtctgtgtgtgagcctctttgtgtgcacacatgtgtgttttataggtttaataagtgttggctaggtgcagtgacacacacctgtaatcccaacactttgggaggccaaggcgggtggatcacctgaggtcaggagttcgagaccagcctggccaacatggtgaaaccccatctctactaaaaatacaaaagttagacgggcatggtggcaggcacctgtaatcccagctactcaggaggctgaggcaggagaatcgcttgaacccaggagacggaggttgcagtgagctgagattgcgccattacactccagcctgggcaacaagagtgaagctccatctcaaaaaaaaaaaaaaaaccacacaaacaacaacaacaaaacaagtgttaagcccactcccatccttagatctcttgagacagattacagaaaactcccatgtagaagagtagagacaatatttttatttttgactagacagttgtatcaacatataaaagtggggtgcatcttgtgtagcattaattgaatgtgcagaacactgaaacatgcctccttgctgcttatttagcaccttagtatctacctttacacatctacaaattatagaccccaggtagtgaatgctagaattagtgttgtaaagcaggtcctattatcctttgggaggtgccttccactgtgacccttttccctcctttctttgtaagaagctaggaaataaaatggaaaatcctgctgtaagatcattttgaaagtataaacttaaatacttggtgtaaaaatcgattctcacagcgatgctaagttgcctgtgttgttcttacatgctattactgcttaatataatagcacacaagtggtatcctcagagcgcgtggcattattctggttcagaaataatgtcttgtgctctcactttgggctcttcaggttacaagtaacagagacccactcacgctagctcaagaaagatttatcaaaagaacctggtaggtcccatgataatccaaggacaggaagcactttatagttggagctatagaaattggaattatcagcctggccaacatggtgaaaccccatctctgctaaaaatgcaaaaatcagccaggtgtgatggcgtgtgcctgtgatcccagcaactcgggaggctgagacaggagaatcgcttcaacatgggaggcagaggctgcagtgagctgagattgcaccactgcactccagccttggtgacagagtgagactccatcagaaaaaaaaaagaaattggaattaggaaacagaaaacaaggttgttttctgtgtgtctttgcagctggagttgccaagtcatggcctttccgcctttctctgtgcctgctcctttacctgtttttgtctgtgtactggacgactcagtggcagcttgttgggcactctagtccttcacagatcatgataattttcagtgtaccattttggcttctgccctgcctgatcaccccaactgtcttgatcctaaattctcaaaagatgcatttaattaactcagcttatctttttttgcccacgatcttgattctgaattcccaaaagatgaatttaattaactcagcttatctttttttttctttccccctacgatcacaagttttaggattctgatcaatctggagattggatattctgctcccactcccacttgcccagtctgctgtggtttggagcgtgaggtgtgggggcctactcctttaaaaaatctccattggatcccacttgggatgggtttggggtaggaaggatgatgatagacatgccttattagaattgctttgagacttgaaagggttcctaaaaggcagcatatcaattccagaaggtggggtgcgggccagtgttgtctctgtgggttctaccatggtgcactgtggccagggccaaaaagtgcagaaggtgaatatagcccatcaaccttaccttcatcttcagatacttgcaaaatagatctcggattcaggtatggctctatgagcaagtgaatatgctgatagagggccgtgtcattggttttgacgagtctgtgaacctcatatcagatgatgcagaagcgattcattgtgaaacaaagccaagaaaacccctgggccagatcgtgctaaaggagatcatattctgccacaaaatgtctctaaccagaaatgatcaaggaagtgagacactattgagaacttgtttttttaggtgtcatttgttgggagtatagttctaaaatgcctgttcagattgtttccattatctgtatatattattaccagatgacagtaaatgctgtgggattgtttttattaaaaaataaaataaaaacaattaaaaacagcccatcagcacttttctaatgttttctggtcatttacatttacctttttgtgacactggcttcttaaacttcagctttatgattttctgtattctgttagactcaaagttagggaccttggcaccttccttttaattttttcagcactcactcaaattcatcctagtccagcctctcatattttttgtctcaaatgattgcatgcattcaagatagaggctaatatttgatagcagagttctgtggtgaattttgaataggaaaatctgatgaaacaacctccattatctgttcaattttcctgtgtgctatttcttaaaacggattcatggctagtttggttctgttgggctgattgctgtgtgaaccttcaccctgttctcagccttttaaaattttagtctaatgcatttacagtttagatattttaacctggggaagtatgtatgagccacacctgcagttttgttaattactttataatcagtaccttaaaacccttgaaaacagattcctaaaagaaggcatgtcacttatattcagtggcaataataattctctaatattttcttctaaagattgatggtaaatattggccccagtatgcacataaaagtaatttggcagttatcttttttgaaattttgatttctaatttaaaaaatagaaaagtttgattagaaagcttattataagtagaatttgcattttactctaaatgtaaattacaagccatgagttgaattttggttttgatggcgattttttaaagctttttcatttttatgttaaattattttacttaaacagaaatgtcctgtttgagtatataagtgctgttaccccagaacctcataatcattcatatcctgggagagatgagtggcagaattagcgtgactcagacttgattttccagggaagtggcctagcttctcttccgaattacctgctaagttttaagaatgtggactctcaggcctcaacatagagctactgcctcggaatttccaggggttcctttcataatctgtactctttcttttaaatttggtaacgaatcccacacacagctagattggggaatgagtctaggcctctagttcccagtctcaccaaaaggaacacctcccgtcagtgtaatttactgcatgttgagaacttaatcatgggtcagaggatcgttccatttaacaaatgctaagtgtgtattgtgtccaaggcattgcaacatgcattgtgtccaaggaatttacaaagatgcatagtatatatgtaataccattaatgccctcaaaatacttttggctagctggtgtatgtgagtctacattgtgatgacttgagttcttcaaggatcatcatgcaattcttaattataacgttgatacactgtaagttgtagtgatgctttaaaaattcttattcgcacgtggttttaggagctgtactgggtctttgtgtttcgagttggctgcttctgtctaggcttggtctttcacatgttaaatttgtgtagcacattttcttaacaacgctgtcataatcatgctactgggcaagcgaattccatgaggaattagcacatttagtgggtttaggttatttttgttttgtagtgaatggaagagcactgtttaaacatctttattacatacctggaggagttgttttgtgaagatgtgttggctttgtgtatcgataatgaatgatcgtttttaggtttcagtgcttgtgatcttggaagtttgtgttcagctttgtgctttcacgtcactaggtggagatgtagcattgtttggcggcataggctaagcaagaggagtgagtcttgatttctcttcttttgacaaaagtactttacagatatttgataaggtttattatagcctaggaaaacacttgtaaatttagtacaattcaaaatttttaacttttttttcaggattgaagttcaatcctacttaagtgtctattttcatactgatcaactcttttaaacattttttttctcctcttactgctgtttcctttttgctgtccctcattatttcaccttgtctgagttattttaatgtctctatctttggttctttatagagatttaattctaaaagtttagtaaaggaatcagaattcttactctgaggtcaaataatagataattaatttggtagcaatatgaagtcaatgaactaaaatttatagtctgaacataccctaatcttatctttgtattattttaggttaataatgtcaatttttaacattaacattctgtagggcttacttttccccctttgcttccttccttctttctctcacctcttgaatattaaacaagcacagtatttactttgcacggtattgatgtggggaatataaaggaaataagagcctgtcttcaaagagctgataatcctgttgagaacattccaaatgcgcccacgaagcagcagttttctactcctaggtatatacccaagataaatgaaggcatatgttcacacaaacatttggacataaaggttcatagcagcactattcataatagccaaaaagtggaaacaacccagatgtctaccagctgatgaacggataaagaaaatatggtatacttgtacaatggaatgtgatatagcaataaaaagaaatgagatcctgatacatgctgtgatgtagatgatgcttgaaaacatgctggtgaaagaagccagtcacagaagaccgcatattattccgtttatgtaaaaagtccagaatagcaaatctatagagataaagtagatccatggttgcctagggctgggtggaggggagtaactgctaatgggttcggaacttctttttgtagtgatgaatatgtaaacttgattatagtgattaatgcacagctctgactatatactaaaaaccactgagttgtatgtactttttttttttttttgagatggagtcttgctcttttgcccaggctggagtgcagtggtgtgatctcagctcactgcaacctctgcctcctgggtccaagcgattctcctgcctcaacctcccaagtagctgggactacaggcacccgccaccatgcctggctaatttttgtatttttagtagagaaggggtgtcaccatgttggctaggctggtcttgaactcctgacctcaagtgatccccctgcctcggcctcccaaagtgctgggattacaggtgtgagccactgtgcccagctgtgtgtacactttactttcaatgagtgaattgtatggcataagaattatctccaataaagatttttaaaaagtaaattaccaaaaggtttaaaatttatcaaactaaggttgttttttgtttgtttgtttttgtttttgttttttgagatggagtctcactctgtcccccaggctggagtgcagtggcacgatctcggctcactgcaacctccacctcctgggttcaagcaattctcctgcctcagcctcccaactagctgggattacagacgctcaccaccatgcctggctaatttttgtatttttagtagagatggagtttcaccatgttggcctggctggtcttgaactcctggcctcaagtgatcagcccacctcggcctcccaaagtcctgggtttacaggcgtgagccactgcacccggctcaaggactgtttgttgaccatctacacaggcactatacgaagttctatgcaagttatgaaacaagtgttaagacacaaacgctgacttcagattgtttacagttcgagagaaaaggcatatatgcaatgtccaatgtcttgtaatgcacctttgctttctgaatctgctccccatctttgaatctcctgaattctgtcttccggctgtttctgtaatggctcttatcttcttaccatatgtcttttattttatcctttaaaaagcggactgttgctcctcagactttgataaatatcagccccagcctgttacctttaactaactcaaaggaccttttaaagtgatagtggcatctccagtaacttaaattgtgtggctcatggaaatctattcattcagcaaatacttactgaggtttcacttacaaataactctggcaaatcacaagactgttggcattattatttttaagatcatgacaaatattcttttgctacaatttagtcaggttgcatggtgcttagaacgtatagtcttgagttcctaaattttcatgaaaaatatattttggtaatagtataagttaaacaagtacgtgtttggtatagagctagctgaattgccagtattctagtatgttgacattgttatggtcattaaaactttgagaaaagaaagccaggcacggtggctcatgcctgtaatcccagcacttttgggaggccaaagagggtggatcacctgaggtcaggagttcgagaccagcctggccaacataatgaaacctcatctctactaaaaatacaaaaattagctgggcgtggtggcacacacctgtaatcccagctactcgggaggctgaggcaggagaatcgcttgaacctgggaggcggaggttgcagtgagccgagatgacaccactgcactccagcctgggtgacagagtgagactctgtctcaaaaaacaaacaaacgaacaaacaaacagaaaatcctttaagaaaagagagattggctgggcatggtggcatatgcctgtaaggccagctacttggaaggctgaggcgggaggactgcttgagcccaggagttcgaggctgcaatgagctatgatcacaccactgtactctagcctaggcgatagagtgagacgctgtcttggaaaaaatagaaaagagaaattttgcattagtcatggtaattctattaaagccacaaaagggtattttgtaaaaggttgtagttgattaattctacatccatccgtttagacagtttatcttatgtacctatagatatatacatgcacatgtgcacacacacacacacacacacacacacacacacacacacacacgcttgtgcctatgttattagtacagcagctaaactttttccttttcttgcagatgcatatgaaacagccaagatgctgtgtgaacagtattacctggtagctccagagctggaagttgaagaattcaatggtaaaagaaaactaattttaaccttacattcaaaaaagctgactaagaagctgtttatacctaagccatatttcagtgagctccaaaaattatactgatttttcattttcttatatctttttaaaactttctacgcttttggtcaaccagatatattattgtaaggagtttttgtacaggaatgtgtaatgtgttagaccccagaattcttggaacagaaataatcaaggtagagtatgtagaaaggtataaataggcccttctcaaagtaacaaatgcaagcagtcgatcaacatatggaaaagtgtttaacttcactaatcaaggaagtgcaaacaaaaacacagacaaatgcctttttttttttttttttttttgagaaggagtctcgttctgttgcccgggttggagtacagtggtgtgatcccagctcactgcagcctctgccttccaggttcaagtgattctcctgtctcagcctcctgagtagctgggattacaggtgccccccaccatgcccagctaatttttgtatttttagtagagacgaggtttcaccatgttggccaggctggtttcgaactcatgacctcaggtgatccacccgcctcagcctcccaaagtgctgggattacaggcgtgagccaccgtgcccagccaaaaatgccatttttgtctttcaaaatgacagtgattaaaacattttaatgctttgaatttgtgcccataaaaatactttctcaccagcacatacatttcttgtataagctaaaagtggtattccctttctaaaaaatgccagcaatgttctttctatttggcccagtaaataagttaataatggtcatattctttggtccagtaaattaaacttcagaacacttattataagaaaatagaggctggacacagtggttcacacctgtaatcccaatactttgggaggccaaagtgggtggatctcttgagtccaggagtttaagaccaacccgagtgacatggcgaaaccccatctctacaaaaaatacaaaaattagccaggcgtggtggcacttgcttgtattctcagctacttgggagactgaggcaggagaatcacttgaacccgggaggcggaggttgcagtgagccgagatagtgccactgcactccaccctgggcaatagtttgaaaccccatctcaaaaaacaaacaaaaatctatgaaaatagagatgcacagatttatgtacaagattgatgatcacagtagttttcttataaagttagaaaacaacccaaattttccacaatagagcattgtttaactgaattgtggtacacccattagatagaatactatgcagccctttgaaataatgctttaaacgaataacgtatgggaaaaattgagatttttaaaaaaatacaggctacaaaagtttatagtagtggagttcattggaaaatattttgaaggatttatactaccaaaatacaaatagcagctctctgggtaatggggttacagatgatttttacgttcatcatatgattacatatttatttgcacattcctttttttatttgcaaattatggaagagacatgcttatcacaaaaatacagatacagaaatgtgactgaaaagggaaatcccccacaactttctcagtcccatatagagctttggtttttgcataaagcatgtatagctttaaccctatttataacgtggttttcacttcaccttgaagacctttgcaagtattaatctcatttagagattatccatagtgtaacttaccataatttatttaactgttttcctatgggtatacatttaggatttcctgttttcctatattccatataatgagctatgaaagagtgtgagaggtggggagggtggaaaaatttgtgaacgtatggaagtatttctgcaggttggattcctagatgtggaatgactgagcagggtgtgagcatttacagttaaagataaaccaggccaggcatggtggctcacacctgtaatcccagcactttgggaggctgaggcaggagaatctcttgagcccaggagttcgagaccagcctgggcaaggtagcaaaaccttgtctctacacaaaatagaaaaattagctggacatagtggcatgtgcctgtaatctcagctactcaggaggctgaagtgggaggatcgcttgagcccaggaggtagaggctgcagtgagccgagatcacatgactgcactccagcctgggtgacagagcaagactctgtctcaaaaaaaaaaaaaaaaaaaaagataaaccaaattccccctcaggagtacactaaaaatgtatttctcttataatgagataaaactgtgaaaggagttcaggctgctgttgaaggacatggcccctccatttgactagaaggcatggagtcaaagctgctttcaaggtctcttgggttctctgagaagagtcatgtccccattgaataaatatactaccaggaccgagtgggcttgtctggagtgttcctgatgagaaccatcttaatattctttctctctcttcctatggactaggcaggagctgatctcacatctgcaggtagtaacaaattgctcttttgcgtgagtggcagcctccctcattctaaaggccaaagcagcaggcctgttcttgctgattcccaagtgccagccatgtcagcacattctgtccccgctgaggctgtcatgctgggcagctcacccaccaggagaggagctttccgactctttttggcattgtctcacgaattacagaagccccctttcgatcatgttttgaagccccttgtcctatcactaagataaatgaatgctggtgtttctaggtagcttctagctttatgttgctttgggtagtgtagtgattatttttatgtataagttcttaatgctagagctctcttgtgagcatgattaaggaatgtgctttcgccttaacaagttctatgttggagatgcaggttggaggttgatcctgaacaccttaagtggatgcttttttattctggaaggagaactgtctggaaataaaattccttatatctaatggtatttcttaaatgctgtttcaactaatggcatttggagcaatgactgtacaaaatagagacttcattatttctgaagtcttgagcatgacaaacctaggccatttttaaattgacttttaaaaatgtacccttagatggaaaattcatattctacttattttataagtcagcaaacatctattaagcatctgctacttaacagccagcctcgagacccagaactaggaaagagtcatggacaaaagcatttgacatggttttaaaaggaaggaaagaaatctaaactgtaatgttcccaaagaaaagtgcaggtaattgagcaagcctttagatggctcctagagaatgttgtttaaactgaaaaaataaaaataaaaaaacccactatataaaaggtgtttgccttttcttgagatttggggtgaaaaggttgaattcataaggctgtttatataactaatcatgccatttggtacaagataaactgagcacccagcttgttcctcgagccccattaaaatgacaataaaggagccaggcgcaatggctcacacctgtaatcccagcactttgggaggccgaggtgggcggatcacttgaggtcaggagttcgagaccagcctggccaacatggtgaaaccctgtgtctactaaaaatacaaaaattagctgggcatgatggcatgtttctttagtcccagctactagggaggctgaggcaagataattgcttgaacctgggaggcggaggttgcagtgagctgaaattgcgccactgcactccagcctgggcgacagagcaagactccatctcaaaaaaaaaaaagaggggaaaaaaagaaataaaaataaaatgacgataaaggaatccaaagaaaagcagcaaaggaaagcagaggagctcattagtggaccagtgccttagtccatttaggctgctataacaaaaataccagagaccaagtggcttcagcaaccatttctcatggttctggaggctgggacatccaagatcatggttcctggagatttggtgtctagtgaggacccaccttctgattcatagctggcttctcactgtttccttccatgggggaaggagcgagggagctctctggagtttctttaaacgggcattaatcccatccataagggctctgccctcataacctaatcacctctcacaggccccatctcctaataccatcacatcaagggttacatttcaacataggaatttgggggagacacacacaaacattccgtccataagaggcatgaatcccaacttttgaaagagggtcactagatggaagtatgctgattggtgggacagagcagaagcagccacaggggaggaggctgcagcagaggtggcaactggtttgccgaagattgtcctggagggactctgggggcagggccaggtggtgcaatggactggaatgggaagggaaggcagagggtagggttaactgaaagctggtctaagaaagagcatggagggatgacgggaggcagctgtactctggccgggttcagcctgccaacaggcaactaagtattttgttcgagaacaacctaggaagaattagggcttttcatgtgagtgttgttaccctgcagcaaagccctgttcgtttaagcatttgggggcctctctgctcagaggcccatttactacctgctcatcctcaagccaagttgaaaagtcttgaccagtccagagagctctaagtcaggcttcccacttaatggagagccccagggggatatgaacgccagctccctcatacagtgaatccggttcttcattctcaaacaagaatattgcaaccaagatggatcagaccttcagcaaaagccagcagcaagaaccaaacctaactggcattaaacttatcagctctactgttactgccagaaaccccccttttgaaattctgagagaaaatcatttcaaacctagaattctctatctagccaaacctttaatcaaatagatcagaggtgtaaagattgacagatgtgtctcccatgcatccctttctgaggtaggttacctgactgccttgatgttatgtataatatgcatctaagaaaggggaaaacattctagaacttcaatcaaaaacaactttaggatgatggctatgcagcatgtttgcaaagcaattgattctaatttgaaaaatcttgaagaatggactggataccatgcagtaggtatggaagctggaagtaggtatggaagctggaagtaggtatggaaactggaagtaggtatggaagcttccagtaagctggaagatcttagcgaaatggcatggaccaactatgaagcaacccaaaaagggtagcatgatgttgaccagttggaggagtataaagaaactccatttcatgttaaggctgggaacattctcctccaagggacacatgaatcattgttattgcattaatagggaagaaaatgtctaggtacactgttgtggttgttctacagtgatcaatatttacatagttataatgtcaccaacacttgattttctactttcttgaaagaacctataggcaatttacagcatccctaatttgggttacagaacagaatgtaaatattaccaacccaaagactacagcagaagtagtaaagagtggctgcctctgggttcagactgaaggataagataggaaagggggaaggacttttgtttttcttcttttgttaaatttttaagccgtttacatatattactaagtgattttaaaaacaactgctcaggccaggcacggtggctcacgcctgcaatcccagcactttgggaggccgaggtgggcaaacacctgaggtcgggagttcgagaccagcctgtccaacatggcaaaaccccgtctctactaaaaatacaaaaattagccaggagtggcggcgcacacctgtaatcccagacactcaggaggccgaggcaggagaatcgcttgaacccgggaggtggaggttgcagtgagccgagatggcgccactgcactccagcctgggcaacagagtgagactctgtctcaaaaaataaataaataaaaataaaaataattgctctttgaagagttcgggatttagactcaaaagctctttgttcaggtgtctggtttcggtgccacttctgggaccacgggcaagtcacacaggcttcccaaagcctgtttccagacctctaaacaccaccacccctctaggagccaggaagtgttgtcaggaggagtcaattgaataatgtatgtgaaagctctgtgtagactgctaagaatcaagcaaatgtgaactctaatttgtattactgttaattactttattagaggaagtagctggttgaaattacagcattctacctgagagagttcatgtagtttcaatctcttaagtgattttgggtcatgaggaggaggaaggactgtatttttgagcatctgctctgtaccgcacactgttcttattgcttcacctgggttttggtgtttctcagattgtcttcagatgacccatggtgcaaggggaaaagatcataggtctctaggggtttatgtgctagctgcttgagaaaaagttatgtgaaccttacattctatgctataagatgccttgtttgtcataatttaacaaaactgaacactgccatttagtccagttcaccagcccttttttttcctgttgctccacattctcccgtggaattccccctggggtcagtggcagaaggtagcccccaatttgaaaaacaccaagtgatatctgactggccttctgtaatactcaggatgttatggcataggtgataatattccaattctgctcaacaaagtttcaaagagattgagtgatttatccaaggtcacatagctggtaagtgaaggaactgggtgtcaccccaggtttgtttgattctaaagcatatgcttttgctcagccctgcctttagaggtggaaactcaaattagccttttatagagctctgttttacacacttggaaaatagaatgcaaacatcattcttgaatttctcctactttgggtccttattgattgatggttttgtctctgttttcagccaaagcgccagacaaacctattcaggtggtttatgtgccctcacatctgtttcatatgctatttgagttgttcaaggtaagtggaattttaaaaacgtggaaagaagtcttcattttaaattactttgattcagggcataatggattcattagattagcataagaaaaaggttttgcataaccattttaaaaattctatttctgatatcctgtgggttttataatttgtacactgtgagatgagaaattgctgtgtacactatagtttttgtgaatattagtacatattgattttgaagcttaattgcactttagtgattttatgtaaaatccatactgttttttctttagttatgagattagagatgctttttagtttccaaacctggcaaaggctttactggtgatagccagatcaaaataaaaacatgtttatacatatttatgcttctgaaaattaaccacactggtacattagtggttgttccagtcctgagagatcctgcaactcttttataaaatatttgaatcaattcagaagatccaagagaggcagaggagaaagatgtagatgagctggaccaaaagaaccacccctcccccccaccaaattctttagagtctgcaacttaagctgttgcttttgttaatcagtagctaatgacatttacagtagcagtattacaggcacaaggcatttgagctaaaatttcatttcttccaatgcgtgaaacactaaattgaacacctgaaaaatcagttatgctgatttgcttccaaaaattagaatgttactgatgtaacgctttaaggttgaaatgggcattcaattgtgaactttctcttcagcagctgtggctttttcagaatttctttttaaccaatatttcttctacttttttcagccaaatgattaatttttgtgggaagcatgcatcctttcagtttttctgccttctttagagaaaaggtgctctataaatgcagactgataaataggatttaaagtgcacaaatcagcctctgcatagcctcattacatgcgataaaaacattcctctgggttgagttgaataatttaaataccgtaaagcgaaaaaaaaaaaaaaagaggaagaagaagaaggaaagaaaaataaatatttagcatgttggatgaggctaaaactaggtgaaaaacaaagtgtcaggaaatttttccttgatttgagcacgtttagctaagctctttagagggaaaaatgccataaaaatccaactaatatttgccccaaaaaagggttgttgggtataagtcatcttgcgcttctttctctttaaaaattgtggtttgtgattcggcagtatgattaataaaaagatcttattattttagaactcaatgagagcgacagttgaactctatgaagacagaaaagagggctaccctgctgttaaaaccctcgttactttgggtaaagaagacttatccattaaggtaactgttttatgtgcatgtatactttaattatcagttgtgatttaatagtatctagacattgaaaaatcagagggaaggaaattgacatttattgagtgtcctgtttgtaagttctatgctagatccttggcttaagttaccttatttaaacttcattagaaccttgttattcagggagttgaacaagacctcaacaccaagcctgttggatcccactgtaccattcggcctcctttgttttacactgttcacaaaggaaccgtatgtcactgggggattcaaagtccttgtacattgtggagtaatctgctatgtactttatttaatgaacccattgcctcctactaagtatagatcaacttctttgttttgattgttaacattttgaacattgcagatcagtgacctaggtggtggtgtcccacttcgaaaaatagatcgtctttttaactacatgtattctactgctcctagacccagcctggagcctaccagagctgcccctttggtaagcatctgaaagtgctgctgaaggaaagatcataaacacaggaaggggctcagagggagctgcctctctccccaggttgtcacattagtgtagttgatttagaaggttgcgtgtattatggtttggaggagggagaattttttgccttggctacttgctttgtgaatcctttggacttcaatttcctctctgatttgtgtctaagaaacactcctagctgagtgcctcattcccatatacagagaaaaagtacctcattgtggtaagactgctactgtagcaccattttccactttgtgctacccttggaaggggtggaagttgccagtgggtgagcaaagggacagtactgaatgcatagctgccgcttggtcctgcgcactctggcgtgcgtaccacagaggcgcgaatcacctagtgccttggaatctccactgtcaaatttgtttatataattaaaatgttaaattatgaaaacattaaatttttatgttaaataacattagcatgaaacatataggtggtgtatgcattttcagagccctttctgtctcactctggaaataaccttcagccctgttaaggcagtgagaaaagccactggttaccatggtagcatttagatcctggtagggccacacttgcttcccctgctgagtgtttctaattgacaaacaacaattgaaccctttgtcattaaacacagcaacatatctatcagtctgcaaaatggttcagggtataaattaagtttcattttaaagtcgtacctgactgataagcacataagattatattttatttgtatgaataaaatcaaacactttgcatcatttatttgagacagagtttgttaactcagcatgttggaaacaggaaatcatttatataggagtcgagaaaattcatgaaagatcacatttgagaggcgttgccttgactaggctctggcatgcacttaaatacacatcaaaaggaaaaaaggcaccacaaacaaatctagcaccttccccagttgtttaaaagaaatatagattgtctcttccaggtcttaaaatagcatcttgaggatagctgttatatcataggttttttttcttattgaaactgagggcttgtaagagacttttaacagttaacgcatgcgcactcccattgtatagatgaggaaatgaggaaatgaccttgtccaaagtcattgaactaattaactgcagagctggtgctggccatgtctgtgttctttccagtgtactacgtggccgaagaaatgcttctgctagtggctctcccagttaggaaactggcctgtaatcctagcactttgggaggccaaggcgggtggatcacttaaggtcaggagttcgagaccagcctggccaacatggtgaaaccctgtctctactaaaaatacacgaaaatagtcgggagcagtggcgcatgcttgtaatcccagctattcaggaggctgaggcacaagaatggcttgaacctgggaggtggagattgcagtgagcctatatcatgccactgcactccagcctgggcgacagagcgaggctctgcctcaaaaaaaaaaaaaaaaagaaaagaaaaagaaactgtcctcagctttaaagtgggcacatggatatgtactactagaaaacataatttcctcattgagcaacttacacttttacaccttttacacctctgtgcctttacatgtgcatttctgtttgagaatatccacccagcgaactcctgctgatcctttgacactctgggaaacctttcctgaacctcagcaaatccgaggtccagacccctcctctgcattctttgggagtctgggcttacactcacatctgcattggcctcggagttctcggctcttctgtgttggacatgagggcaggctctgggccttgcttgaacatagaaggcagatttgctcacatctcttcctagagtgagctagtttctttgctgtggttacctgagtcactactataaatatctcatcttcactactggccatattcagcaagtcccaaagcccttaaataatggggtacgttcttttaccccctgccctttcagttaaaccctaccctgagggaaggtatcaaggagagatgttagaaaatggcagaaatctgtgtaacttcataaaattgctgctcctagtagccatagtaccagcctcaatttatttagttttactgtgttaggcactgtgccaagattttatacttgttatattatttaatccttatagcagctctgaggtcagttttttatcatatgttcagatgaaaacatggtctcaaagaggttgagtaaactgctcagagtcgcacagaaagtggatttcaactgggtctgtctgagtctaaggcccatgtgactctgtgcacatggtcccctgccctccttccttaaccttgttcatagatttaaccagaagtgaggaagcttggtgttacatctccttccccaccctgccccactaccaccacaaatggtattacatttagttttgattcttactgttcttgtccatagaacacctgttattgacagtcaggattccttgacatagagatataggagggtactgaaaatttttttaatctctaaaaatacctgaactacaatataccaaaatattctcacattcccggaaccttagtagttgcctctcagaaaattgttttcctttccatgttctcgtcttgttactggtagatttgtactcagcactgcgctattgattttcacttgcaaaagcaaggaaatctgatcatgggactttgaaatgatgtggtttagttttgtcatcaggtcacattccacttgatttggaatgtgcttttgtgtgtgtgtgtgtgtgtgtgtgtgtgtgtgtggagatggagtcttgctctgtcgcccaggctggagtgcagtggcgccatctcagctcactgcaacctccacctcctgggttcaggcgattctcctgcctcagcctcctgagtagctgggactacagtctcccaccacctcgcccagctaatttttgtagtagagatggggtttcgccatgttggccaggctgatcatgaattcctgacctcaagtgatccacctgcctcagcctcccaaagtgctgggattacaggcgtgagccactgtgcccggccttggaatgtgcttttaaaaaaatgataaaattttgctttaaaatgctaaaaaagcattagtcaaaaattagaatatttctattattatccaaacatataagacatgtttttgcagggtgaaaataaaggggttgtttgccatagaagaggatatacatcattgtaaaggttgagtcagtaatttatttgatttaaatctgaatcaagaatttattttaaccttctctgaatggtcatcatataaaatgtgttagcatttgtgcctgtctcactgtattaattttcttttctcaataggctggatttggttatggtttgccaatttcccgtctgtatgctagatattttcaaggagatctgaaactgtattccatggaaggagtgggtactgatgctgtcatttatttgaaggtactgcgttttatttgttagtatgaggcatctttgctttttaaagctgtaagttctaatcgctgattgagaacagcactgtatcatctcttagattcatctcagatttacttcattttcccatgaaaaccatgttatgcctcacgcttgattctatgctcagataaagcaaaatatgaaacgtggaggtatagaaattaaaatactgattttggccgggcgtggtggcacatgcctgtaatctcaggactttgggaggctgaggtgggtggatcacctgaggtcaggagttcgagaccagcctggccaacatggtgaaaccccatgtctactaaaagtacaaaaaattagctgatgtggtggtgcacgcctgtagtcccagctactcaggaggctgaggcaggagagtcatttgaacccgggaggcagaggttgcagtgagccaagatggtgccactgcactccagcctgggcgacagaatgagactccatctcaaaagagaaaaaaaaaaattaaaatactgatttttaaaaccataattttaaattgtgacttaaaaaactacatgcctattgaaaggtctgatctaaaagaaggcagattttcataaactgaagtattttggtcttttgttttaaaaactcactggctttcccaaagctacaagaattcagtaatcataatatggttatgtaaaagattcatttaataacaaacttctctgtaacacagtttttcttattcattggtgatcattgggcttttatttctaaactctagaatatttgtaacatttttttgaataggtaatataggcacataataaaaatttaaaagctacaaaaggaaaaatgaagtctctcctcccactggccctaaaccgccagttctgttcagcgaagatcaccaccggtctcagcgtcttatggatcctcctagagttgattctacatttataaatatgggaaaaatagaatttttcccacataaatgaaatttcagcaccttcttattttttttactttgcaatctgtcttagagatctttccagatccatttatgtagaactggctcattcttttaaacagtggcataacatgccactgtgggtcaagcatccctaacccaagaatctgcaatccaaaatggttgaaaatctggaactttttgagcgccaacgtgatgcttgctcaaaggtcaagcttaaaggaaatgcttattggagcaccccagatttcagattttcagattagggatgcttaacaggtaagcacaatgcaaatattccaaaatcggaaaaaatcagaactacttctggtcccaagcatttctttctttcttttctttttttttgtttctttctttttctttttttttttttttgagatagagtctcactctgtcacccaggctggagtgcagtactgccatctcggctcactgcaacctctgcctcctgggttcaagccatgctcctgcctcagcctcctgagtagctgggattacaggtgtgagccaccacacccggctaattttttgtatttttagtagagacagggtttcaccatgttggccaggctggtctcgaactcctgacctcaggtgatccacctgcctcagcctcccaaagtgctgggattacaggtgtgagccactgtgcccggcctgttcccaggcatttcaaagggatactcaacctatgtatgtgataccagaatttaaccagttactgggagtatttatcttagatgcccatgcatctaagtaatgcgatatttaatatacttgatggtgtgtgtttataaacctgggatgcatgagactgtatctcttcctgggccctttgtgagaccagtcaccaggtatagtcaaaacagttgagcatctcaaagcagtatgagctgaattaaaatatgttttgttctggtcatgtgtatttcagttctgattttgaatgagcaaatgttttcattcctttaaaaaagctttaatgttttcctggccagtctaagtaaactactaaggtgtaattttaatatcattttgaaaatatgtattaaggtttctgatgttttaaataataaaatttgggttactatttcacttgagaaaaatgacactgtcgacctttggtgtatatttttgtttctccaataggctctttcaagtgagtcatttgagagacttccagtttttaataagtccgcatggcgccattacaagaccacgcctgaagccgatgattggagcaatcccagcagtgaacccagggatgcttcaaaatacaaagcaaaacagtaatataccaccttgatttccattacaaagtatctgatttgtctgaataaaggtgtcccactcactgttccaggaattcttgcagtgtagaggtattcacaacagcaagcagggatttggcctgccatcaattttatttaaaaagcaattaagtttgcagtttgtcctcataaacgttgtaggttgaaactgaaaaataagttaaaatgatcaatcaagataaaaggtgatctatccatccaatggaatattatttggccttaaaaaggaaggacattctgatatgtgctgcaacatgggtgaatcttgaagtcattatgctaagtgaaataaaccagacataaaaggacaaatac

SEQ ID NO: 3306 - DNA, 74381 bp, human; identical to SEQ ID NO: 3304

SEQ ID NO: 3307 - DNA, 69204 bp, human; identical to SEQ ID NO: 3305

SEQ ID NO: 3308 - DNA, 12254 bp, human
ttgtcctgagcgcggagagggcgagctcgggccgcgggcagggcgggagccggcagccggcaaccaagggaggcagaaaggcacaaagatcgcaataatatccgttataacccgctatctaaccccacccccaacacacacccatccatcccaccctccgggagaggcagccggcgatccgctctctgcgccctgggaaaaagccccagccatgagcaatcagtaccaggaggagggctgctccgagaggcccgagtgcaaaagtaaatctccaactttgctctcctcctactgcatcgacagcatcctgggccggaggagcccgtgcaaaatgcggttgctgggagccgcgcagagcttgcctgctccgctgaccagccgcgccgacccggaaaaggccgtgcaaggtaaggatgctcccgtcaggcacttactaagggcattgggccctgatttggatgtttggtgttcgggggccagtggcctggaattgtcaatttggagaggaaggaaggagagggcataactctgaggcctgctgcctcaaagagcgttaaacatctagccagggctgtctctccctccctccctccctgcttccagaaaaaggcccgttttcgcttagggagcctttagcttttcggtgttgatcgttaggttgtttaaatgccccttttggtggccttgggtgtgctctgaagagcggcgacaggtcagaaacagtagatggccggtggacccttgtagcaccaacttgatgaagacaagaagcccaaaagctggtgaatcggggtctccaggctgagtgagccttggcctttcctctttggaagatttctgtatatgcaatgttttggttttatttttttaattgcagattacttgtgaccttttaaacccaagctttgcagaaaacatcttcctgggattctccaaatgctccttaatgtatttaaaatgtatgaaatgtgtgacttctggatgctaattttttctctgctattttattttttaaaatagacgagctgtttaaaatattttatttttttctgaaattaaaaattccagaacaaatgtccttttaccccgaacctgttatcctcaagtttcgcctcgagcttgctgcagaggtgtcgcagggaaaggaaagaactgttggtttcttttaaaatccaaaaaccagcggtccggccatagcgcaatttggatggcaggagcagacggttgagaagggggcatttaaataaaactgacttttttcttttctttttttagcctgcagtggcacctatgccaggcgcttcctcaaaaggaaggagcggcctgcgcctgctgcactcccactccctctctgccccagacctttcccagaacatttttgccaggatgatttttctttgcctttttgtgcaagaagcccccccaccctctcccgctgtgggctgttggggcgcggcctgcacttggggccacagggccgctttcccccaccccgccccgcagcggtcgccttcagggctgcacccctcttgccaacccttgccctcatggtggagcagcgggcagaggtcatgcgcaaagttttcaggatagtggtgattttcttttaaagttgtagaatgttttcggattttcctctgccccgacgtgggaagggaaataaaaatgagagagtaggaaaggggaaagagaaaggaataaagaagaaagaaggagagaggggagagaaagcctgcaaaaagagaaagaaagggggagagaaggagaaagagaggtgaggaaaagaagggagggggagaaagaaaaagaaaaaaggtaaggagagaaaaggaagggagagaggggcaagaggaatagataagggaaggaagataggaaataaaagggggagagtgagagagggaacggaaagaagggagaggaaaggggaaaaaagaaggaacccagagaaagggagaaggagagaaagaaagaaaaagaaaaagcaagaaaagtggagaaagaggccaaggcgtcgaagtctggtggtgcgcggtccccgcacgcctgggcctaggcactgggggagcaactgcgggcgggccccggcagcagccctggctgggactccccggccggccggctggctgatagctctcccttgcccgcaggctcccctaagagcagcagcgccccgttcgaggccgagctgcacctgccgcccaagctgcggcgcctgtacggcccgggcgggggccgcctccttcagggtgcggcagcggcggcggcggcggcggcggcggcggcggcagcggccgccacggccacggcgggtccacgcggggaggcccctccgccgccaccgccaaccgcgcggcccggggaacggccggacggcgcaggggccgccgcggcagccgcggccgcggccgccgcggcctgggacacgctcaagatcagccaggcgccgcaggtgagcatcagccgcagcaagtcgtaccgcgagaacggggcgcccttcgtgccgccgccgcccgcgctggacgagctgggcggcccggggggcgtcacgcacccggaggagcgcctcggcgtggccggcggcccgggcagcgccccggctgcgggtggtggcaccggcaccgaggacgacgaggaggagctgctggaggacgaagaagatgaggacgaggaagaggaactgctggaggacgacgaggaggagctgctggaggacgacgcccgcgcgctgctcaaggagccccggcgctgtcctgtggccgccactggcgccgtggccgcagcagctgccgctgcagtggccacagagggcggggagctgtcacccaaggaggagctgctgctgcacccggaagacgctgagggcaaggacggcgaggacagcgtgtgcctctctgcgggcagcgactcggaggaggggctgctgaaacgcaaacagaggcgctaccgcaccacgttcaccagctaccagctggaggaactggagcgggccttccagaagacgcactacccggacgtcttcaccaggtatgcgcgtagggtggtcgcggtcgcagcggcagagagcgcacgcgggccccagggagggacagcgggctggcaggggccccggcctcggggcggacgcttggctcctggactctgtggaagagcgccctcccaacacacccacccttgctcacccaaactacccactcccccgacccccaccccggttcgggctttaagtttaggctggaatggtttatcttcttcccaaggtcgttgcagtttaatgttttcaaattacaagttttagttagagagaggaaaagaaacagcctctccaaagagcgcccgaaagcgccaccttggagacgcgcgcacagcagagggcacagacacaaggcctccggagctgcggtcccggctaggtccccggcgaggctcaggaagcgctgtccgcagacagagcaaagcaggggctatttttggtcgctgtgctgtgcgctcgccacccccgcctggtgccccaggggcctggtgggtatcagttacgcagttcgcagtgaagctggagcccgtgccagcggagaaggcctttaaaaagatccgagttctgtcgtttcaggactcctgaaataaccaaaggaagtcagaactgggcagtgtttggtgtctgaacacctgaggggccccagccagaatctccccttctactctctgtcctctcccgacacacatattaaacccaccgtgcgtttaatgtaaacgggtttaccgggtggacaatgattgctggaagcctggcagggagtagacaaagcagttgggggaattttctctttggatcagtgtccaagccgggtgttcgacctggtcacgctccacctcccacttgtttttctgggaaacatgtgcctgtgtgatgactggaccctcggccccagcttattcaccacctggggcgccggcccgggtagggatccttctctcccaccccaaggccaagttctcagctcaggcgaggagccagtcttagggcaaacgtcccccagtgagggggagaaagggatcggtgactgcctagcgcggggcttgtcaagcgcgggcagttccttcgaaggagacgtgcgcagcttttcaatgtgcattttagaaggggaatgctgcccgcccctttgaaccagaggagaaatcgctgcttagggctcgggaggccgagctactccaaaatgtagttggcctggcaattgcctaactctctcccaaccagaaacagaaaagagcagacttaatgccaggcaaaggcacttaaacctggtcatcccttgggctacacttggtcttcccctgtgtcacccagtcctttccttatctttaaaaaaggaaataagtttgaaaacctatgtgtgctgtcaaatagcgaattggccgaccagcgttttgcgtttatcgtacgtgtgtatttccaaagaagaaactgagctggtgtcagttggcatccacgtccgccctttcttagcttctggcgggcttaggggcgggggaggaccgaagtgcacgaggaggggcagctcctcttccccgccccacccccacctctttccaacccaggggtttgagccccttggctccggccctgagccagcctggagtgccgctttagatttgctgatgcccactgtagctgggggcaacggcaacggagggcacttatggagacggtttacctctggtgctgaagtttcaggtgtggactgggggcctaccggcagggcaaccccaggtcccaggcttcggcggccccgctctttcatattagcgagccggagggccaattattctcggcgcggtcatattttcggtaaacaggttgtaagccgttttacagcatcttaatggtttcctatttgccttaattgtcgcagtaataactgcaatgatggggtagggtttcagttaaattgacttcccctgagatgggcagggtttgtagtgggcattggagtcaggaggtgcgcagaattttgtttaatcgaaaaattaccccactgaactcttaacaagcttaacatacctgcagagggtaatggggagtgtgacccaaggggatgatggagggaggaaggcgggggagagagagatggagggaaaggcatagagctggaaagagaagaaggaagaaggagggaagagaaatttttaaaaagaaggcagaaggaaaccaagaggacagaaaaatattttcttagttaagtgctgagttcctatcccacttaatattaggacaaaacagggtataagcagtgtgtgtgtgtgtatgtgtgtgtgtgttgtctaactctggcttaagacagtgagagagaacctgtgtacccaggtttgtagacttgaagccacccttggttgtcacacacgaatgtagtatgatataatagataatatcctatatctggtaatgtgcttcgtgtttttgcattttcagtcaaatagttggcactccagggggtgatggaatggtaatgcccatatgtttgggggtggggggcaggcagccaggggagaccctggtggagtaggcctgccatagaggaggaaatagctgagagggcattgctggggcctgcagtgacctcctgtctgtgtgttgctttcttatagggaggaactggccatgaggctggacttgaccgaggcccgagtccaggtgagctgcacaacagagggaagagggagggaggagggctgggggccagtgggagagagagagatgggttggtggcgggggggtgcggggggtgagatccccttcacaaaaccaagagaagcaggatcagaaaagtagacccaagcactctctcacacacaaagatatttaaaacttaagacatgggaggtggaagcgggaggtttctgggtttgggagcccaaggaaggagtccaggatcagaacaagggctttagagtccctgagactgcagtttgggaccccctagccccaaagctcctataggaaacaatccaccgatctacttctcctgattgaaataatgggatggagcatggatttggttgttagacaaatccgctcagttccaagcaggtatttggctgcgattaagtctccaatcgggcttcataaaagcccacttagtgctagaacaaacagggccatttgaaggcaaaatgctgtttgatttcccctccgccccgcacaaggagctggctaatgctatttgatttcccattttttatagcaatgaacccacattgatctaatagggagtgagtgcaatgctattaaaggtgtttgcagccccataccagagtgcatttccgaacccaggcctcataaccaaagagacgatcaacactgagcagccccgatggccaacagaaaacagatgtccccgagttaggagctgagtgaatcactttacagtcaaaatcaagcgctgataaagcacaataaattccatatggctcatttaatacacaacagcttcttgcattagagggctaatgatgaggcctgtcccctcctttctgttgacacatttctccattgtcaaacagagatgtgacagcaactccgtattttcagctcaggggaacaagtcgtgggaaagttaaataacttttaaaaagaaagagagcgccccctccctttctcctctccccctattcactggagaagatgtaattaagtgaatatgaattattagagtcctttcgtttacctttggggggcctcagaggtattaattcaataatgaggaattgcagggggacatcttgataattgcagttgagccgggagagacgatctgtctgtaaaaaggtttccacgttctttgagggcattctgagtccactgcccccagttccccttcttctttcactgcgatcaaggagtggcggatattcttgtctagacagatttggctacacaaaagctgcccacccagtccggtcccatctacagtcttactttttcaagcctctgggtttccacactgaagtgtttctgaaattcacaaatagattattttgaaggctgtggaatggtgtgaatgggcccccttttggccgacttggaagtaattgaccgatttggattcttgatttttcttgccctggggggctgtctagaagtcaaaccaagcttagatgctagtgctggtaacaacaagccccagtgtgtagatttgaaaaatatggatgtgtttcacattttaaaatatattcctctgggataatttacattatattttaatataactctgtatagccctggagttcattcttaattttcagacttgtgtgcagttataaacccagccctaaaaatattaatgccttcaggggagaaggagcatatcttcccagctgtgggtgtgatgagcaggtcacataaaaataatttcatgctcctggggtttatttttagatgatggtagctgccatgtttcaggtaaaggtctccattaaaaccgctttctattagcaattaggaaaatacctcaggctgaaaacctccctccaagcctaaaactatcttatttaaatagccgatttaaaacacatctccaaaaggaaataaaagacttgttagctctgaagatgtgaaaagtctacacctatcatgccctctgatttctatgcgcccaggtattgctgcctgcttcatccatgtagtcagtgccttcctgcatagaactgggtcctgcagggatcccctgccaagagcaggttgtgtatccctgtttcatttcatagaggattgaccccctgaaatgtatgcttgctaattaactcgagcctttcttccctccctctcatccctctctgaaccccagaacccagcatagtgctctttggtgttcaataaatgtttctggaaagaataaatgaactatctttccactttcctcttccatacagagcaagaattttgccagctcttgcgtaaatctgaaataggtgaaaatagctgatatgcagtaaaacaagcatgtccctcatctcttggtggctgcccattccctagagtcaccattgaatgcatgctttcacttgccttattttacccagttctcataacagccttatgagtgaagttttattatccccattttacagattcgaaaactgaggttcagagaggtttaagtgacctgcctaaagatcctagcaagcgtcagcacagacgtttaaactttggtttccccaactctaaacacactgaatcactttccttaaacttggaaaactggcccaggtggaatgccggcagaaagggtttgcttgtcctgtttcctgctgacttgaagttgcggctcctattcactgctcatttggccccagacgcgtccgaaaacaacctgaggccaaagaggggcaggtgggcgcgggccgcggtggaaaggaagggggccccgcagcgcgccaagggaagggacgggtaggggcccggtgcgcccgccgggccgagccgcgccgaccctgggctctctctgccttgcaggtctggttccagaaccgtcgggccaagtggcgcaagcgggagaaggcaggcgcgcagacccacccccctgggctgcccttcccggggccgctctccgccacccacccgctcagcccctacctggacgccagccccttccctccgcaccacccggcgctcgactccgcttggactgccgctgccgccgccgccgccgccgccttcccgagcctacctccgcctccgggctcggccagcctgccgcccagcggggcgccgctgggcctgagcactttcctcggagcggcagtgttccgacacccagctttcatcagcccggcattcggcaggtaacgcgcagcctcggaagtctgtctgtctgtctgtctctcatacacacagaggctgggggcagggaggaggcaggagtcaaacagggttacacacatctttttctttgacccaacctcagagactgtagccaaagaaaatactctctaattgagcctcaaaaaaaaaaatgtgggtcttgaaggtattgacttggaacttaatgggaaaggggaaggcagtggcagtaacgacaaccgtgacaaccgagaatgaaagctgtaaaagtaccatttgcaggctgcaacaagtcccaccataggtggtaagcgagcaaatatgtacaggtgtagggtacagagcagggacgactttttaagttttgcaaaagttcttccttatgccccccaacctggcagcctgaggaacacagccctgatccccatgggagccctggagccaccaggccctctgggtgcacagaattctttcttctgccccagactccatcttccttgtcactcaagtgacccgctgccaacgacacccccatatgtgcaagccccgatctacacggcagtacaagacaacgaaataaaagaaacagttcatcttataactccctttctttaatgaacatcgaatgaggaaataaaaagtctgtataatcacacagacaaagaaacaaaggagggatgtattgtgttagcgcagtgaaaataaaactggatgcagcttcaatgatcactctttgggagaacaaagaaataatagattcatccaactgcgcagctgcttaacaaaaaatcatcttacagaaaattaagactcggagtaaatttagtttcttataacaaaccaataaaataaacagcgagcgcactgaagcagagttagtgactcagtttacctaatggaaccagggcatgttacgccacctccgggtcacactttatcatttctttctgagaaaaatcttaaagttctgtctctcccctccctccactttttccctctgacaagtgacttgtaaacccaggcgaaccgtggctggaggaccgagttgcgagattcggagaggctggaagagggtctgggctggggtggtgcgaggagtgagcagtgggcttgggagaaggaggcggcgctcggtgagcccaggtgggctcatttctaaccctggaaatccggaattggccccgcgggcctggagccagacccctcagggaggcggtcgggaaagctcgcgggcgctccaaggcggtgggcgtgggggtggtgtccggtggccccgggcggctccggccacagctaatgtcccggtgctgtgtgcatggggtggaagcgtcacgtggagtaattcggtcgccgcttggaggcggtggcgctggcgtgggtcccaggcttgggcatcgccttgcgccgcgcgccagggtcgtgggtcgggggctccctgaggccagaggctacaggggcgcggggaagacagctggggtcgccgcgccaggatgtggggctgctggcaggtgacacccgcccgtggagccgaaatcaacaggcggtcgcccttcactctcacccgcaggcgctggccagacgcgggtagctgagtcccgcgcggaagggcggccgcggcggcgcgggtggcccgggaggccggcgagctaggcctgtttcttcagggcgcagaaagtcccgggccaaggagccggagggagatctcagagcctgcggcgtgcgtccgggcagctggaatcccaccttctccgtcttttttttcctcccccctcccaccctccaccttcccttcttttgctctcctctccttttctccttccgcattctctcctgggagatagtgtcattgcagcccctggccttggaataaaccgtccgtttaagcgaaaccaccgaatccacgccactgggccgtggggcttgaggtctccacgccggcctgtggaccccggcccggcccggcccctcggggaatatctggactcggtcttttccccccagtcggttccctgccccaggaaagccctctctgcggggtccagcttccgcccgcgccctctgcccacttccccgccgcggcccatccgggtcccgtgggtaccgcgcccctcagctgccccggcgacaagcggcgggagacgctgcccgaggcgccgcgcacagctcccgaggccatgaccgcgctgtttgctctccctgcaggctcttttccacaatggcccccctgaccagcgcgtcgaccgcggccgcgctcctgagacagcccacacccgccgtggagggcgcagtggcatcgggcgccctggccgacccggccacggcggccgcagacagacgcgcctctagcatagccgcgctgaggctcaaggccaaggagcacgcggcgcagctcacgcagctcaacatcctgccgggcaccagcacgggcaaggaggtgtgctaaaggctgccctccacacccgcgccccgcgcgcgccccgaaaggtcacctcactcagcaccactcaagaccaaatggaaacagaggaccagcacactcccgagacggcactgagagagcgcagccgccttcacagcagtctggatgcgggcatggcagccctcggcgctccgggacgtggcacctcctcggctggctgtccacccgcccctgcccctgcccctgctactgccaacctcgctccaactccaacatccactctctcttgttcttactttcctgaaaatatcggggaggttttctcccccagacgcctgatattgaagtaaaaaatttaaaaagcccaacctcttcctcctgacaccccacttagcctttcttttctttctttctttctttcttttttttttttaaatagcattttggcgctcgaagttgatctccccagcgagggccccagcgtgaagccagggcccgggaagcaaatgcgagcctgtaagatagctaacagtgcacttaaaggaaaggggcgtcttgttcttgttctcttctttatcatacaccaaccaaggtttttatatcaaaccaaagggaaataatactctgctagaatatggactgttgaagtcaccaaactgtgattattgattctgtacataccattgttattaaaaaaaaaaaaaaaagaacagagctttgtatatttgaaatgttataacgcaattgcactcagcgtggtatggtaaaagtttgtcctcccgtagattcttactgtgttgtagatacggtagggttcctagacaaatatttatgtactcaagccctttatttaacttattaactgtagaggcttccgaaaccttcaagataaaggcaatggtacagtacttttgtgtaatgtgtaattgttaccacttttccttgctatctagtggagaagtgtcacgctcaaaataaaaaaattatatgtttaacaaa

SEQ ID NO: 3309 - DNA, 690 bp, human
tgaaccaaggagactcaaacccagcagctactccgcatgcggcagaagacattcaaggagatgacagatggatgtgtcagcacaacagatttgttttggactgtaaagacaaacagcctgatgtaccatttgcgggaggctccgtggtgcagttactgcagccatatgagatatggcgagagcttttttccccacttcatgcactgaattttggaactgggggagatacaacaagacatgttttgtggagactaaagagcggagaactggggaatactaagcctaaggtcattgttttctggctaggaagaaacaaccatgaaaatatggcagaagaggtagcaggtggtatggcggccatcgtacaacttatcaacacaaggcagccacaggccaaaatcattgtatttgatctgttacctcaaggtgagaaacccaaccctttgaggcaaaagaacgccaaggtgaacccactcgtcaagatttcgctgctgaaacttaaccaacgtgcagctcctggatactgacaggggtttcgtgcactccgaccgtgccatctcctgccacgacatgtttgattttctgcatttgacaggaggtggctactcaaaggtctgcaaacccttgaatgaactgatcatgcagttgttggaggaaacacctgaggagaaacaaaccaccattgcctga

SEQ ID NO: 3310 - DNA, 71588 bp, human
agaggcgagaggaggagttttccagcccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggtaggatcggaggcgtggctgcctcctcagctgggcaccaaagacccccggagtcgccgttgggacccttcgctcgggatagagggaggtgccgggggcgccctttgtttgcgcagaactcctctttcgcagcccgagggtggggatgatgcggatcggggctggtgtctgggcacgcgccgggaagaactgaccatcccatctccaggcgcggggcgccctcgcggcgacgggagccctagcaccttctgcgtccgggcttccagagttccaatcaaacccttttcggtgtaggaggctccacagagaaagtttggccgcagactagtttgctactttctcacccccagaattttgcctctcacatggttgcccactggaggctggcagcttgtcctggaaggagcctctatgccctcccactacacgtcccaggctacccccttggggccgcaggacacgagccacggtaaagcgacttttgtggaaggcacgggcggggcctcccctgaatctcttaaccccccctgctggggattccgagaaagtctgcgcctctgaggaagaattgccagctgagagtggtgacatgtggcatgcacttgattagccccagggaaagagggctactcgcgcaaggatctgctgggcagagggtgcggcttattcctggagggcgtggtctccggcatctaagggggccctggtgtttcttgggggctctcatggtgtgagcaaaattctctttggagatgcactttaaaaagctccagctaacttcctcaccctggagtcttaggttagcgaagagcttcaggggagtagggcaatgtgccatgcactcctgttgcctcggaatggagaggaaatccatggatgcgttttaatttagtgttaatgggaaagtgggtgacgtcggctatagggcgtgcaaatatttggctctgcgttcaacaccgtgggcagcttaaatctagggtatgagaaatgaacctactgagttctggtagaaggatagaggatgcccatctttctagcagtgtgcttgggagatgtagggatggctgcgggaaattctctgcacgcacctaaataaatgaatgaatagaacaaatttgtaaattaataaacaggaacatttgtgttttgagctgactcttaagttttaagctgctttgtaggaactgattcagggtaaagtggaaaggaaattttatccttactgccaggcaactgttattcccatggtgtgttaatacctcctctcccaccccctttagcaggaatcaggttaaaatgaacctgtaggggaagaggaagtcattaagcgtcccagaagcagctttctgggagcgggcaaataaggtgagaagctagaggtagcttttccgcactgagttgggaggtgcctgtgagctgcctgggaacctcaacttttagttgagcctttctcaagctggggaccccttctccttttccatccgacctccctccgttctcctcccctgccctcccctctcctttctctcatcttccacctttatatagtacagcttgctaccagggcccagccacagaatcatgagttcgccagtttgggcattcactaccacctgtcttttgggacctatccctggctttcctggctccctctgccagcctgcaagctgctcccaacttttagccaccatgttcctgcttgccaccacctccactgactcctaacctgccctccggctctgctcagaccacaaatgagctgaagctgattggagctgcttgataaacactcctcttgagcctccttttggcatggctcaatggggtctcttgggaagtgtgctccgctgaggttgtgagatccagaggaggggatttcagtccaagccagaggctttggaaggctggggaggggaaaatctctaggcccttgggtctgaaagcaaatcacataggctgagttcactctaagtgctgggtgacaaattttaaagatcatttcagagacactctcttagcaagtggacatcatatcttcagtaagagagaaagtgaaggacttgaatctggaacttctgaaagaagatggagatctagggctccatcagcaagtcgattatgtaactatctgcacgtgaatagcacatctgtcagagtgagagtaaatcattctcattcccactcctagaaggtctctggagttcttccatcttagaatttaatgcagcttttctggctctctgatctattttttgcagcctagcaaagatgcagtgtctataaaaacctacatgaagtgtatggaaaatttgtagaaaagttgtttgtgtttgactgtgtttgtatgcttataacagatgagaatttagattctgttcttaaaataattcttagagctgtatttgcatgtgagatagtggtggttcactctgcctccttctgcaaacaaggctgaagatggagaatgagtaccatggcctctaagaaaggcttcgtgaatcttacatctggagaaaactggtaaagtagcgtggttttactagtcaggaaaaccaagtgaggtttgctaaaagccaaaccagactacatcagctgaagcagtcttttgaaataccacatttggagataagtactaggaatggagcacctagctcaggttatataattaaggtgtcaccgggaacaggctaggaattcctatttagatttaaaacatgtaatcagctgacaaaagtactctgcaatgaaaaggaaatatgctggggagagcaggtcattttcctctggcattttcttcattgataacactttcagtacagtacaatgttgtttgttagttactactcatttcgcagatttgggagctgaatgagacaccagaaaccattgttaaagcagcgtcttcacatcttcccacctcatcagtcctcgtaccataaccaaagtgctgcttttctcttttagattattgctataacattctcacttttggtctctctaattctagctcattttactttctcactttagataatggtcttttaagtccattgactttagtactgttttttatcacatcactcccttactcaaaaacttagggcagcaggtccctgttctcactcaagtaaaaagttctcagttgtttttagggggctacacagtttgcttctagcctaattttccagtcttttccccctggtttcctaaaatcctatccttatagaacctgagtcacattttccttcttggcagatgctgctttctgtacctggaatccttcccccttgccatttgtccaaattctgcccatcatccagcaacacccccactttgatgagaccttttcttgatcgctccaatgggaagcaacgtgccttccttttaacacccatggtctcactcatgtctcttatatttatcacatatatcacatatttgataatgctgtatattatcataatttatgcactcttcttcttgtagattttaagaccttggaggcaggggccgtgctatgtcttacccttatttgtatttcccacggtgcctagcagagcactttgtgccacatggatatttgtgcgtaatggattaacagtgcctgtaactccagtgatgggccattggacaggaaaggagctgagggaaacatgtgcacaggtacacagggctttgtgccaccatgaatctacatacatagaaacgatggcttactggatacagaggttccttttaaatatacgaacactctctgtttaagcaataaccttctctgttgggggctgtaagatgagagactgactgcaaccgcaagctggagtttgcatttattatttttgttggccaccttgatctgtgcctttcccaagtggttgaatggtttccttagtaaacgcaaatatgtgtgctacgtcaattcccctttcagagaacacaactgaaattagtaattgaaagtgaagagagaatttgaacagaagaaggtttagttttgccaggctataacatagtatgaaatttgtagcaggcaagttatgattaatgcccaggttagagattcgcttccaaaatagcagcgtgaataataacctctcccaacttccaattcatagggagtttctcaaaccagcccctcagttcttgactgtgtgatgtcttaactgctaacttttatgggccatttgttttaggagggtggtcttttaagcctgaatctctgggaaatttgggtttagttctgaaatagaatcagtttctaccttttctaataaatcctgggctctgcccagagacttatttttaaagtgaacactgaatgatgaagcatttatgtgcttgggagaccacgatgaagaaggtatgcaatttcttctctctcgtagctttctgtcttgtggggaaatagagacatagttatttcaggtggtcaatgttataatacaattggattgacaggcccggggagcacagagaggagctatgtgggaacactggaattggttattgaagaatgatgctgagacttgctggtgcggagatggtggcactaaaggcccaagaaaagtgaaagtagaggatgtgtgggcttctctaagaatgttttgaaattggagacaaaaatctgtgtgagtgtcctttttctggggagacggctctatcccgattcaaaaccactagttactagagcaccttcatgaattctatgagaaaatatgcacttaatgggcagaaaaatcaacatacagagtaagatgaaattaccacagtaggtaaactttgattgaaccagtgagcaggtggcctttccagttacagccagctgtatagtttccagttattttcatttaaaaagcagtaccaagcaaaacagatgtaatcgtaaattgtaattgccttcaggcctgggctggtaacttgctgtacccccctgccccacttagtacacagtgtgacttgggggaggatctttagtcagtatttgtggattaattgattgaagtaattgtgaatcaaagtattccatttcaaatctcccctgtaggatttaaccagaatttccaagatgacactttcctgagaaaacggattgcaagatagctaaatgtcaaaggaaatttgtccatttggacaggcaacgaatcagggcatagttaattgcgaaggctcttggatgtcaaatcaccgtaagacattctaagagacttagaaactcaagggagttctgggggcaggatgtgcagataaagatttagaggaaaagcttgtgcaagagaaaagtccttggtagcactgctaagctcccaagttttccagatgataattggtagcacctggatcttacgggtgtctggcacattctgacctcagaaacctctggagtactcattcccgagctgaatgattcactcacccgtaatccttagctcacaatggatgcttctttatgcattgttctccagggagaagataaatgggtttggacataatggcttggattatcccagaggtttggggttgtaaattgagcataatgattttcaaactttcttctgagtaatagatccaaacatagaatctggggacagactttctgccttggccttgaaatatcattgcaatatttcttctgtcccactcttacagtgacctgtagtgtagtcacatgtactagcagctcatttcccctgctatcactagctgtttgcaatgtacatccagtagtacttaatgagaatctcctcaatgctgattacaccccatgatctgctaatggatgacgctcgcctgccgcttattgtgtgggtggctgagctgaatgaccctgccaatcccagtgatccaagattgttcgcaaacacggttaaattagggccacagggtgagaattaagccaaggtttggcaggcccattgtggagtggtgaggaagcggtggagcggctacatcctccacctcctgagattctgcccacaaagtggcaattccttataggaactctgacagacatgttggtactgactcagtgttagtcagatcaaggctccaattcctttcaatccccaacactgaaattttgtttccacttagattttaattcagctttccaaggagtagggtcattgtgttgcaccattacctattcacggagctgatgcccccagccacgtgagtaggttgtgggatcttgttcatttttgtattctcatggtctagcagggagcctgacttctgggaggctctcagtggatctgtggagtgacatgtgctggggggcatgcctctggccagttctgagcctctgggtgggtgtcttggtctttatctagatttctgcaggagtttctctgttccacacccaggctcccttgcatgggttgcctaattcatggaaccacggaacctcagactgggaggatgcctgagatggtaacttgccctgcattttagggaggagcctctgaggcttagcaagttgaagggatttgtctggggtcacacagagagttaaatgcagagttgggagtagacctcagtctagtggctatagaattcctttcacttcataggcatgcattgaattcaatttttgagtgatccctacatgtcaggcatcctgtggggaaccagagataggcaggcaagaatgaatggcactgagcatttgatatggtttggatctgtgtccccacccaaatctcatgttgaaatgtaatcttcagtgctggaggtgggcctggctggaggtgattggatcatggggggcggatttctcatgaatggtttagcaccatcccctttggtgttatttttgcaatagtaagttaccataatacctggttgttttcaaagtgtgtagcacctccttcctctctctcgctcctgctctggccatgtaagacatgcctgcttctccttcgccttctgccttgattgcaagtttcctgaggcctcctcagaggtagaagctactatacttcctgtacaacctgcagaaccgtgatccagttaaacctcttttctttataaattacccagtctcaagtatttcttcatagcagtgcaaaaatggacgaatacagcattgttcactgagcccctgtccagggtgtatctcagggctattctttatattgacacttggctgtactctcagcatctcatatctagagctgtttggatgtttttcaagagttctgagaagttgctgcctcagtgtcagtccttgccctcttttgaggttgtcagagtcccaaatgcttcctctctataccatttgctttgagctccccaactgatttgtgattaaattcataacagttttattgagatacaattcatgtaccatacctcattcatttaaactgtacaattcaatggtcttagaatattcacagagttgtgcattcatcaccacaaccaattttagaatgttttcattgccccccaaataaactccaaaccttagccatcatttcttaatcccccatccctaggcaaccactaatctattttctgcctctatagatttgcctacaattgaccttccataaaaatggaattacacagtatttatcattttgtgtttggcttctttcacttagtatagtgctttcaaggttcaactgtggcaggatactagccagagtcagccaatggtgcctggccacctctcaatgctggctgcagggccaccactggtgcataaagcacctttgggtgaattagaaaaagaggcccccatctggccacatgtagatctgtggacacagggcttggtcaggagacagactttgggcaagaaaaggatagaggcaggcccaagactcaaggacttgaggccttgagtccaaggattcaagacttggagagtggaggacaggcttgatttgagaccccacttgctctttttgagggtgtgacggtgggtgctgtagtgcagggaactccctgaactatatctatgtagtcctggatgtcagtagcttaactccaagtggacaagctatggaccccatattcttttagagcttgtgactctgtaaaataacaaaacagaaagctgtgcttgcatgccagcagcatctgtggtgaactcttgggtcacctgggagcacgttaaaattgcagaagctcaggcccaaacccaagacctactgaatcagcatcttcattttaacaagatccttccaatgattcttctacatgatgaaatttaggaagtactggtctgatgaatgagttcagcccttggccaagacagagtggcttgcctgtttataactgacacacaatggttcacttcccctcctctcccttttcctgttggctttgccttcatcactgaatcctctgaccttcctttcctaagtccccagcattcctgagataagcatgtacagcctgtaggttaggtttttcctcccttctctaactcaaaaacaaatgcaacctcccttggcttcatctccttttaagcctttctgccaggaatacagcccctgcctggcttagccttgagcagcagcaaagcacatcttcaggctgattggtaacaggggccttgcatggctttttcctgcagctaagatgtattaatacctgatgaataactttagctgtcaagaaaaccaggctagtgtgatcagggccgctcctgccactccggcaagactcctggggctgagaattcctggaactgatcagctcttaaagacacagggacttcttatcttcataccagaaatcaatgacactggggttagcggggaggcagcaccttgggagatgagtgagagtgagaccagtgggttagtcaggaaaacacacagcccctcacattaagcccctcaagctccatgaattggggatgtcaggaagactgaactgttaacagcacttaaagagggtctctcaccttttcagggagttgggtaagtagtagtttccaacccagcaatggtattttttttctctgttcttttcctcttttttttttgaccgagtcttgctctgtcacccaggctggaatgcagtgacatgatctcggctcactgcaacctccacctccaaggttcaagagattctcctgcctcagcctcccgagtagctgggattacaggcgcgtaccaccacacctatctaatttttgtgtttttagtatagatggggtttcaccatgttggccaggctggtctcaaactcctgacctcatgatctgccctcctcggcctcccaaagtgttgggattacaggcgtgagccaccgtgtctggccagcaatggtatttgtacaggctgagtaaggatcacctggggagtctgatgaaatatggtttccctggctccgcctctgtgtattttgatttggtagatctaggttagggaccagtaatctagggtgaaggtctgcaaacaaagtccaggcaggccaaagatggctcactgccagtttttatatgattagttgagctaagaatggttttaacattttaaactgattgaaaaaaaatcaaaagaataataatgttttgtgacaaatgaaaatgatataaaattcaaattttgatgttattggaacacagccatgttcattcctttgggtatttgtctatggctacttggtgatacgatggcagttgaatagttgtgacagagtccatatggcctgcaaagctgaaatattttcctttacagaaaatgtttgccgaacccctaatccaaggccttactcaaagtgtggtttgataaccagcctcacctgggagctttatagaaatgtagaatcttgaacaccatcacagatatgaaataagcacctaccttttaacaagattcctgggtgtttggggctacttcttccccaccacgaggctcagctcaggactcatcttggaggtccaggccagcatgctataactagccttgtatacggttaatttatctgacacataactgggtgtctcattctcaaggtttgaggcttggtagcctcctgatatcttagatgctctaaaaactaggttgctgttttattcttgccaattcttggctaggatccagtgtcctaatctgaggctggaggtggactggcttttgctacctgctgacatatttcttaatgcttcctggatttctagacagcagtctccagatgtgctgccctgccaggatcttggtatgtagtatggcccatagctctccaccgtctcctacttccttccatgaagcactgcttcccagagacattcagaaatggtatatgggaagcaggatgcactgtaatttagttgcaaaaggctgggttaaataggtttctttattgcaggactgctcagggtcattgatatgccagtataccttgttactctctgagagaggacaaggaggaatagtgaggaccacagaatctcaaagtggggtctgtagaccagcagcaacagcagcagcatctcctgggaacctagtagatatatacattctcagaccacaccccagagctactgaatcacaagctgggtatgtgggaagtgggcctagccatctgtattttagcagatcctccaaatgattcttatgtacactcaagtgtgagaaccactggtgtggacgtttccaaatggttttctccgaacatctcactagcctagtgtttcacatttgttgatttcagtgaacactgtgtttttggtttcaggacaggacatttgggaacatgacattgaatttttcctgaagcatttactggtggcagtgaccactgcaggcttggggaggtggaagtggggaagaaaaaaaaccccaacctttgggtagcatcatctgtcccacatctgtctctctagcaattgtgtcttggttaaaggaagtttttttgagacgaaagccaccaacttttgggtgttgccaacatgtgttctttaaaatgtgtttttgtgtattcaaatgtaaagaaagctggggaacagcccttggggtgtttctctctcctcttcacgttacttcctttcagaatactttcttctgtaaaatttcctcatccaaattccaaactcatcttttcaggccagccaagtccaaatggctttcatttgagtgagtgacccttttctccatgggaagcctcaggacacattcagataggagggaagctatggctctcagcatgaggaggctgtgtcttccttctcaaagctcagctcactccctcccattccagaccttcttcctttgccttccatggctagtggtgtcacagccatgggtctgtgtgtgaacactttttagtgtttactctgtgaggatatgtaactgctgtgttgtcacttagtttgaaattctcagtgatagtgaggcttgagggtgagttgggaggaagcactaagttattctacttcctccatgggctggccgctgaggagaggaatgagggttgagaaagccatgcagaccttgattttcagtgaaaatagatgagacaactgacaacttccatttctatgtttttggtgggcagaaaatagatattatcgtttacttttcttggcttggtggtctgaatgctacacatatctataaaatggcccatctgatattgcagatgagctgaaagtatcctctgatgaatgtactttaacaaggctttcaaaaattgtaggctgaccactttttttccaaaattttttgcaaaaaaaaaatatatatatatataggctgagcacagtggctcacacctgtaatcccagcactttgagaggcctaggcgagagaatctcttgagcccaggagtttgagaccagcctgggcaacatcttgggaccctatctctaaaaaaaaaaaaaaaaaaaaagaaattagtcaggtgtgctggcactcacctgtagtcccggctactcaggggctgaggtgggaggatcgcttgaacccaggtggtcaaggctgcagtgagccatgatcatgcactgcactgcagactgggtgatagagtgagtccctttctttaaaataaaattataaaagtaaaacatgctcattatgaaaatattcaaatagaggcataaaaagttgaaagcaggcccacccttcattttcctcttgattccattctctttttctgaaattgccactcagtagtttgatataaacttctggacacttttctgtgcttacgattcttaaacaaaaaaggtaaaaaaggaatgtattgctacatgtaacaacagggatgaatctcatacataatgttcagtgaaataaaccagacacaaaagagtacatatggcaattccatttctacaaagttcaacaacaatgtgcaaaactagtccatggtgttacaagtcagaatagcagttgtctttatggggtagccactgggaggggccacaagggggtcttcaagggtgccagcagtattctgtatcttgatctgggttgggaggtctcatgggtatgcacatacatagaatgtattgagctgtatacacttaagatttgtgcactttactatatatgtttacctcaattataaagaaaaaaatacccacaaatgtatgtgtgggcggggcataaatggatttaagatgtctttgttaaatttccatgccattgcctatgggaactttggaaatatatggtagtgatttgggttgtcataatgatagagaaggccaggcctacacaataaagaattggctcccttagaatgcccatagcgcccacattgaaaaacactgttttaaaagtttgcagactgttctattgggcaggtgttcagaacatggggtaggcctttgaaatagtcttgcctggatctttactctgtctttgtttaaatggagttgaagcctcaagagctgatgtggatggatgggttcttgatttgtttttgccttctgaaccaaattgtaaaggagtggaatcatctcctttgccagggaacagaggcaatttgataaccctcaaatgtgaacttgatgcaagagagagctcttctccagctcagtgtatccctcccatgctcatagctctctgaggccatgtggcctccgccagtgtcttggtctggagtcttctgctgaaagtcttactgcatcctcctttcctttcttagattttctctgtgtcccatttgacctctatagaggagagttaagcatttgaaggaccacatgccacatcacaaattgcttttgttccactgtctggttttactttaaaggctagccctctttttgtctgtctgtgttgactggggacagtcaggctacagagctttgtgaatgccccttggtgagaacaggacttggcatttattgaggtcccctgctttgggctgacctcctcagatttaggtgtttgtcttttttctgtttctcctctctcccatctctgggcaatgggcagggacacactttggcccttcgtagtattaaacaatagaaggagactaaattggaaaaatattattttccccttggaccagagtaatgccttcatttataaagcttttcttttaagtttatttttgttggctctgtaaagtaggaccacaattgatatttcacaagccacatgctgttttaattgtctttgctaatgaaagacagagggcctggggattatgggtgccatggactctgcctagggtcttccttttggggtctgcatagaagagtttgaataagaggatggaatattgtctaatattgcctctgatgaaacagctgtggaagcaaggctgtctctgagagctcatgtctggcagggatcattctctcaccagccagccattctactgccatttatttctggatgaaataaagttaaaatgaacatttaagtgtagcctcaatggggaaagaagttatgtaacggtagtatttggatgccagagagggaggaagagtccccagcaggatggagccccaattgcccacaacagtgactcacagcagttgcccagtgagcagtacccttattgtctttcttctcttcgctgtctctctgctctagtccatcgctatgcttcctgggattgcttcccaaatgaactacttgtactttgtcttagagtgtgcttttgggggaactcagacaatggctaagctggaacttaacccaggattttggtttctggtccagagttctttgtactgctgaattgactcctgctgaatagaactctctaggtcactgaatgaactgtaaagaaggcttctgtgatggacacttggaggttgtttcacttatcttttgatgcataagaaaccactccaaaacttagtggtttaaataagtgacaactatgtatttactcatgatcccgcagtttgggcaggactttgggggacggctcatctctggttcacatggtgttgtctggggtgactcatctgggtctagaggatccgggatggttccactcatgtgtctgtgtctgacacttcatctgggatgactgaaatcgctgggatggctggtccctctctctgcctctctgcagtctgcatagtttagctcttttccatctccccgtgttgccttactctccagcaggaagctggcattacatgcagctggcctcccagtggacaaaagccaaagctaccaggacacttaaggcatagatccagaattgtcacagcatcacttctgttacattctattagtcaaagaaaatcacaaggcaggcccatatttgggatggtggtggtagtggatggagtctacctcttatatgcatgtgcagggtgggaggaattgtcggtggccactgtgcaggcaatccactacagagctggtttgggacggcatattggagatgggagtttaattttccaggatgtttgctgggtgccttctgattagatgctggacctcaggttgctagccaagtgtattaggctgtttagctacagaatgtggcatatgcagattcattgaaagttcatagaagtgagtaaatcagcatccctgggaatatcaaaggctcattttccaatggttattgatactatcaaagacaaagactttattaaacaaaaatgaactcaaaatagatcatagacctaaatataaagcctataaatatgaaacttcttgatgacaacatgggagaaaatctttgtgaacttgagttaggcagagatttcttgaatatgacaccaaaagcatggtctataaaaggtataattgataaattttactttattcaaattaaaaacttctcttccaaagaccccactaagagagtaaaaagaaatatataaagaactctctaaactcaataacaagaaaaaaagccacctaatttttaaagcagacaaaatatttgaacagatacttaaaccaaagatgttcaatattattatccacctgctaactggattaaactcaggcaacttctgctttcgtctgccaactgtgaacaaagccacctgctcttttagggaagtgatttgtaatatacagtgcaaatgtaaggtatggttatacctcccacaaaacaacttgcacacatttctgctccttgtagagggctgactagccattttctctgtctctctcactggactttatgtgacagacacccgcaaattgctagccatggccgttaagtaaccactggccactggcaatttgaggcagatcatttactgtaagctcaagtggacgtgggtgtctcctaccatgcttttccaaaccaggctggtttttaggcctccctaaaaaaatctcccactgcctacttgttctgccctcaagtgtcctgatgtcctttcatttcaaggaacttgcatcatttgagcctgtaacagagggcttttagtcttctttggtactattgatatgtaagaaatgtactttgactttgatgtttttctttgaattcatttgtaagcaatggtaaagtttgaaatgtattacttcatattatcatatattattcttctcaagacctaatgttaaattcaatgctgagtgcttaataaggatactgattacatgagaagtaacagaacagttttcatctagtttctaaatttaggggaaaaaaaagcttggatgaacgccaaataatttcccacttttgtgaatcccaaaggcccctcttcatgcattgaacattcctgaaatttctggaataaaaaaaattgtgagaagaacacacagggtttttaaaaacgactttttacttgaggtgtacttgccatgtaataaactgtactgaattgctttcataccattttcaaaaattaattggaaatttttgtacagatctgtttctgggttctttattctgatccattggtttatgtgcttatttcttcactaataccaatactgtcttgattactgtagttttgtaatatgtcttaaaattgggtagtgtgattcctctaactttattcttctttccaaaattgttttggctataaatttcatataaattttaggatcagtttgtttatatctgcaaaaccttgctagtattctgatggcaattatgtcacacctactgatcagtttgggggagaattgatatccttaatatttgaatctttcaatccatgaatatggtacatctctccatttatttagatattagttgatttctttcacaaacattttttagttttcagtatacagatcccatacatgttttgttagatttataagtatttcattttatggggctactggaaatgtttttattttcttaactttcctctctaatagtttattgcaagtatatagaaatacaattgatttttgtggtttgactttgtatcttgtgatattgctaacctcaagtgttattttgtcgattctttgagattttctacatagacaatcatgtcatctgtgaatagggacaggtttttcctttcttccttcctgccttccttcctttctttctttcttctctccttttgttgcgcaggctggaatgcagtggcacaatctcggcacactgcaacctccacctcccaggttcaagtgattcttccacctcagcctcctgagtagctggaactacaggtgtgcaccaccatgcctggctaatttctgtatttttagtagagatgtggtttcaccacattggccaggctggtcttgaactcctcacctcaggtgatccactcgcctcagcctcccaaagtgctgggattacaggcgtgagctaccgggcctggccagagacaggtttatttcttcctttccaatctttgtatcttttctttctttcttgtcttattgcactggctaggattacctgtatagtgctgaatagggtagtgaaattgagtgttgtgttgttcccagtcttagggggaaagcacctcagtctttcatcgtaaagtataatgttaattgtgggctttctgtagatccccttcatcaggttgaagacattctcttctcttcctagattgctgtaatttttttttttaaatcacgaatggatgttaaatttcgttaaattccttttctgtattaattgatatgatcatctggattttcttctttagtttgttaatgtcatgggttgcattgattaattgatttttgaatattaagctaggcttccactgtcaggatacgtaccatttggtgttaccatattattctttttatgtagtgttgtgttttatttggtaatactttgttggggatttttgcatctgtgttcatgactgatattgtcctgtagttttattttgatgtgaagtccttatctggttttggcatcagagtaatgctagccttgtaaaatgagttgggacatgtgttctccacttcaattttgtggaagacattctgtagaattcttttaaaaatatttgatagaattcaccagtgaaatcactgtgcctggagatttatttttaggaagattatctattcatcttgagtgagttttgatagttcgtgctttttgaagaattggttcatttcatctaagctgtcaaagttatgtgtagagttatacacagtatctgctgtgataccctctgtttcattcctaatattggtaatttgtttcttttctttgtttttctttgtcagtcttgcttgagttttgtcaatgatatgaatattttcaaaaaacagcttttggtttgattgtttccattgtgttgtttcattaatttctacttttgcctttattatttttattatgtcctgctgcatgctttgggtttgttttgttctgtagtttcttaaagtggaagcttaaggtattgttttgaggccttttcctttttctaatataaacatctgatgctgtaaattcccctctgagaactgttttatcccactcactgtactctctctcctctcctttttgaactctattgactgaaatgttaaacatatggatattgtcccacagctccctgaaaaaaccaagattaaaaagaagattgaaaaaaaaagtttattgagcaaggggaagaccaagaaagacaaaaagtcacaaggagtcttcctaccctcttaagaccacatcttctctacagagaaaaaaatctccattcccagagttttaggtatctagagtttgctatacaattgctgtagtcgccactgctgtcactcctgcccactgtcaccacagggttatatgggggctgggtcatgaaataatggagaaaatgaacataaaagaaaaccagggaattttcttcattctctctgaagcattacagttcttcttttccactcttagagtcagagatagagggcttctcctggaactctctctgtacccagtgtctacttctgtgtttgggctgattttagtctagtcctgggataccagagcaacaccaattcagtgttaccccaaattcttttttttttttttttttgagacggagtctcgctctgtcacccaggctggagtgcagtggcgtgatctcagctcactgcaagctccgcctcctgggttcacaccattctcctgcctcagcctcccgagtagctgggactataggcacccaccaccgcacctcgctaattttttgtatttttagtagagacggggtttcaccgtggtctcgatctcctgacctcgtgatctgcccacctcggcctcccaaagtgttgggattacaggcgtgagccaccatgcccggccccaaattcttagtctgcctgctaatgtttactttttcagaatcaccaaagagctgttcagatgcactttgttcaggtttttcagctgcattcagtaggaaagacagggtgaagtacgattactgcatcttacccagaattggaatattgtgacctttttttttttaacattacattatccttttcatggtagtcaggtggttttcttcctcccttccttctttctttctccctttgtttcttcttttctttattttctactttttcttcactatgatgcctagtatattgttagacctggataaataacttttgactgttgcagatggtgaaaagtcttttgtgtgaggttttatagttattacaatttagagaaaggattggattgtttatcattggaaaacactttgttttctaaagatatatctactaggatgagagaagaaaaaatcacgatctaaaaagtggggagtaatagtcttatagagtcactgtgaaagttcagaggaatgatatatttgtaccaggaacaaatatgttacatttgttcctttaagtaaattcagtcccatccaaaaacgtatttattgacattagctcatttttgaaagcctttttaaaatgagctaatatcaataaatatgttaataatgaaaggaacctaacaatgcagaatgattaggcatcaaatgctgtatgtttactgtggtttgaatgtttgtcccctccaaaagtcatgttgagatttaattgctgtagtaacagtattaacaggggacctttaagaggtgattgggccattagggctctgccttcatgaatagattaatgccattatagcaggagtgggttgttagttatctcaagaatgggttcctgataaaagggaggagtttgcctcctctttccctttctgtctcatgtactcccttctgcccttctttcatgagatgatgccgcattaaggcctcaccagataccagtgccctgttctggggctcctcagcctccagaactgtgagctgaatagacttctcctccttattaattacctggtctgtggtattttaacaacagacaatggactaagacagtgtccttcttctgctttattagatagcttatttcaaaagtgaacaagcaatcctgcttgtagtctgagaaatggaaattgtggagttgagggagattcagtaaaagatgatctttcagatgaggctattgttaaacttttcattaaattgcttttattttggccctagtattggtatcatcaaacattaaacagtcttaaaaagtgaaatgatacccagtcatctataaaagagtgaattgtgagaaattatatggcttatttcccagtagagacaagtgatttcacattctgcagcagacccatgagccacacaagtcacatgaaaggtggccatagctcaggtgtttggctcagctttctattctatccaagctatttctaatcacagatgaaccagccacacattcttattttgagcagacatctgaaattgacttcagcttaattgcaataacactgaggattggaaaacatttgtgttaacatctacattctgttcaaaacatcaacaaaagccaaatcccccaaattaataggctcttttgaagacttctcttttgaataaacagtgttgacatgtaattcatcattaactcataaaaacacttcagtaatataaatcaggattgaagtctaaaagccattctgctttcaattagagcatccaaatctggtatacgagaccttttctcctttttttttttttccagccactctgttattttgtcaatctaatctcatctgtatcctgctcacgctctaggaatcaagtctttccctcagatgcaatgcctgcattctaattttaaaagtagttaatagaatataccaattccatgtttaaacaggaagaaactaaggctcctgagaggtgatggggctagccaaagtcacatggctagctagtagcagagctagatgaggattcttagcacctcactccattattttaccctagtcttctagaaagaccctgtgctgttcccagagtctcacctctgaaatatcacactttttttattttttttaattattattattatttttttgagatggagtctcgctctgtcgcccaggctggagtgcagtggcgcgatctcggctcactgcaagctccgcctcccgggttcacgccattctcctgcctcagcctcccgagtagctggaactacaggcgcccgccaccacgcctggctaattttttgtatttttagtagagacggggtttcaccgtgttagccaggatggtctcgatctcctgacctcgtgatccacccgcctcggcctcccaaagtgctgggattacaggcgtgagctactgcgcccagcccacactaaagttttaaattcagtcacaaatgtttttcaataccttataagtatatgaaccaaaaccaacttgtgatgacattaggttggtgcaaaagtaattgcggtttttgccaatggcaatgaaaaaaaacctcaattacttttgcaccagcctgtagacgtcaggatagtggcaggtttctgaccatgttctgtttcttgatctgagttctcttacatgggtgtgttcagtttataacagttcattgaattgtgcactttttaaaaaataaaatatttattacgagtggcttatggtattatccctgattgttgctcgggccccagaacttaatatgttagtaatgtcctttattatgcaacgagtcacctttctcatccagcttaaaaaataattttcctcttaacatttttttattttgctctccagtatacttttgcttcccagcgcctgcctaatgtttgtaccatcagtgttgtagaatcctacttcaaaagaagcatttgctacagcccagaatcatagcggtaatcatgcagtgatcttagcccccaccccagggtgcttgcttgtttgatagtcactgtgagtgttcctaataagccagggcatatctggattcatcatttatcattttctgtgctccaaggctccaacaatatgtgtgataaatagcctgtagcttattttctaaatgacagcagtgaaacctcctgtttttctttctttgaattgaatctgagacacatgaaattggtattctctgaggcttctctcttctccctccccacatttcttttacagcaggggaaaaggcagaaacctaagtttgtgattggtagtggattgaaagccgtagatccttttctcctctccagagctaaggaaatgatcttttgtgagcattcatcactctgcctttttattatttctctctcttacctttagagtcttatttcgtcctgtcctccacctttctgtacaccactccctccccaaaggttgctttttcatagcgtaaaagttgatcctgagtatgtgtgcaagacattatttggtactacaatttcacagaatcatataatcttaaccttggaaagggctgtagagccccaccctacttccctcatctcacccctcttgccagcatccttcggcctcatgggaacacttccagcttcagtaagctttgatggaatctcaagatggtcttggagtcttagaataccctgcctcacactgggctaaaatcagctctacatgacatctagccattgtccttatttctcacttttggtactgcacaaagtaagtttctctctatttttatccatgggatgaccattgagaaatcagaacacagggattctatttccttttagtcccattttcttcaggctacaaatctaaagtttattcaccattcaacaaactttttatttatttgtttacttatttatttgctatgaaagctagtctctgttggtcattttttgttttttctttctagcatcttctggcatgtctgtgtccttctcaaagtgtggccccaagtgataaatatttgaggtgatagatatgtaaattaccccaatttaatcattatgcattgtatgcatatatcaaaatatcactctgtattccataaatatgtacaattataacatgtccaaaaaaaagaaaggaaaaaaaaagaattggcccaaatggtctgttattccagtgtggttgcttcagtctaggataagccagacttctttggtttagcctctgtcctcttgcaggccactgttgctctctcttttttaagaaactatttcacctgctggctcacaatgtgggcaactagctggctgctctttcccaagcctgccagggaagctctcccccttgctgggtgtacagcttagtgtagggagagaaatacaagacttcatgtttataatctctatttaatttctccttgtaggtttcaaactagctatggcctatggtttcatcatctgttggttttgcccatctgtagccaacattgttgatgccctgtgccatctcccctccgcccatctctggattcatctgcagctgaggtagacagttctcaaacatgctgacagtttctcaccttagatgtccacatgtcttagaggctttgcctttagatttactccagtcctgtgggagctcgctcagcaagaatttctggaagagtaggagatgtaacaccccgccagctcttagccaaaaaaaaggcaggagtctgtgggtaaatacccaacctttcgtgtccctgggttgtgtttcctcagaggctcctcagtgggaatgaatccaggttgcccccagaagtaacctgctcattagcatatctttatgggcttttcccctattcctttctcatttcccctgctttctcactgtgcttcctgggatcaccttccaaatgaacaacagcacccaagtccttgtttcagactctgctttgggagaaagaaaactaagagcttgtcctccccagcttggttatcttctacagatttgttcttcttaattcttccttcactggtagaatgacacagagccctatagcatatctcctgagaggaggttacctgttaatgggttgtgaaattcttgtagtggtcatgattagcactttttaaacactcaaatgtaatagaatagcaaatatgagagggcatcatacttaaatattgttccatgaaacttatttttcgatcatataaatgtatgtgtgtactgagtcacaagatgaaacattttctgtggattgtattcaaaaaagtgaaaagtaattgctttctgtgaatacaattcataaatcagtatttctctgaatggacctttatgtaaactagatttactagaggaggcattctcttgggtaaaccaaagaaatgaggttactttggcctgatttgctatttttgaaccaacgctgattccaaattgtcactattctaaaaatttcttcctattttttttgttaataatctgttctaaaataacgcttaggataaaattgaaacttttcatgtctatggtttccatactccatatttttactgatttgaaaattgtctatccacagcctttgacacttctttggtttcccttaatttttcagtgattatgaagaataatttcacgtccatcctttatattctttaaggccctgggatgtagtttccttggatctggaaatttgagctcaggtaaaattgccagctgggatctcgttactcttgagcccttcttcctaatctgtggcttttccccatatataatattaaagcaagaaagatatttaggtggactttaaggaagaaatttcaactttcctacaagtaaaatgttgagaacagcttgggagtaggctgggaaggctgtctccaaacttttgagttttcattgggactctctcagtacttgaggctggcgtgtgcatcagattgtcttccaagagtatttccagatctaagactctctaattttattggcaaagcatatcttttagttggaggcccaaatggtaatttttaagaacttcttggataaacatgttcttatcattgcaaacaaatgagaaacaaacctaacaagctctttgcatcaaagatattttaattgctctgcttgaaaaattttaaattaaacaatgagtagaaaaaaagaatatttacataatatgggtatggtaaaaaaaaaaaaaaaaaaaccacaaacacctctacttaccagccagtttaataagaacttaccaaaaaaagagcaaaaactttaccctgtagtccttgctattctttcctttggattcttttcctttcgctatctcctcagaggtaaccaatgtcctaaattttgtatttatcattcctattattttctttatagaatatgtttatatctctaaaaatacattatttacagccgggtaaagtggctcatgcctgtaaccccagcactttgggaggccgaggcaggcagatcacctgaagtcaggagttcaagaacagcctggtcaacatggtgaaactccatctctactaaaaatacaaaaattagctgggcgtggtggcacgtgcctgtaatcctagctacttgggaggctgaggcaggagaattgcttgaaccgaggaagtggatgttgcagtgagccaagatcgcgccactgcactccagcctgggtgacagagcaagactgtatctcaaaaaaaaaaaaaaaaaaaaaaaaaaaccaaaaacaaacaaacaaaaaacattatttacatttgcatgcttttgacttgtgtataaatggacacatgctgaatatagtcttctataacttgcttgcttttcttcacttaacattagattcttaagagttgctcatgttgttacatgcagttgtgattttttcattcacgttatcttgtaagatcccattgtgtaaatatgccatcatttatccatgctactcttgatgtgcattttgggttgttgctagttttatgttcttgtaaacagtgctattgggaagattcttgtctatctcccttgaacaatgtgcaggaatttctctagactaagtacctaggagttgaattgctggataatatgcatacatatctttgactttgttcaataatgccaaattatttactaaggaagttataccaatctaaacttctagcaccaatgtgtatttccattgctcaacatccttgttaacacttgatcttgttatatttttagagttcttccaaactaatgggtcagaaatggtatgactgtggttttaattattgttagtggtattttagtaataatataatagtaataataatatggttattaattctcaggggaaggattttccttctttcactcactgctggggtacaagatgagaacttttctttgtagtccctatacatgggatggatttatttcactctttacactgagagtataggctgttggtatatcagctttatgtaggaggtgagggtgaggggatgtaggcagtctcctctaaaactgatgaccttgaatagtctctggagtttgtcttctgtatccaaggtctcaccagtccatggaaattaaagctcagttttggcagttatcctcagaataaaaggtgagccttaatatctggtacctaatcaggatcctgctttcacagtatttcttactttcttgcaagctaaaagtggatttttttcattgattttcatgtaagcacagccaggctacatggctcaccatactgcctgaaataggatcctaattgcttgactttgaaattgattccattttcaacctttagttactttcaaatgtatttcatgatattgtgccagagcaatctgtaatttgatgtttgaaggacatatgtacctcctcaaattatcctcttcagatttacaaactagaaaattctcagtggagatggctgacctaccacttgttcaagattttacaatgagacaaaaagttgccatttgcaagcatttgaggaaaatttttgggtgttcatcaagggaggagagaaaaagactgcctagggtgtttcccatttgctgcctgctttaatttttcatttataattccttgctcagaatttcattgaagaggggaatttctaggaagcattggcattcatgctctaaaaatgccctgtcttaacttccctaatgcagccttaacaatgatgaagatcccatacccagtttgattgtgctgtgtaaaatttgaatgtgacttgactactacacatagaagaacattaaaagacccatactaacaaaacaattactgacaggttttgttagggctgcaaaatagtgtgtttgcatttccccccctccccacctttcttttttggataggtttcatgtgaattcatgtgagtaccttgattgaattaaataattcatgtaaatcacccaaggcagtgcctgaggtagtgtctgttaactaaatagtaggtatttcttctctcttacaagctaggactgtaaggactgtgttaggactcactggtgtctaccttggccagtaagaccagataagatggtgctgtacaaagctgctcctgcatggtaaaaggctggagaaatagttgctacttcatttaatttaccttttatttccttcttaccctggactttcatctgcacaccaggatgctggaaaattgctcagaaagactcaatttttggcaaagttccctttagggcacatactgcctttttcactggcccatggtttctgagaactgccctcatcgctgcaaatgaggacttcaccagcccctccagtcccttccctgcagacagcctgccttggtcctaggggaaggacaaagggagcctgtcactgcaggcccttctccagcaagggactgggaaggggccaacatgcctgcaggctcctgtattgacaagttgcagcatccttaagagcagccaagaaataaaatggtaatttgtgtttgcatctggaatttctgagcttcaaaatcttggatcacagcactctcaataacagaaaacaggacacacatataaatatccatatccatattagcctctttgttaaactctgtctgggtcagcagctcgagactgaaaagtagcaggatgattgtacaggaagtagaatgaacctgaatgctgtgtttcagggcaggggacagcgggcatgagagggacgagaatggcctccccatttagtggaccctgagccatccccccagggacatctagagtttgactatattatggcttaaaacagctcttatggactctctaggggacctgatcaccactgataatgtggtttccaaggaaaagccaatttcaaattataagcaactgatttataaatgcactttggggatgctgccatctgtaggtgagaggccacatgactcccctgtcatcagtgccctgatactttggcagggttacaagccacgctgtgcctctttgtggggctctctttagctgggcagtgggctaaatgtggtattcgttggatagcaccagaagcctatccatgcaacatattatctccacttgcctgttctgctgcctgaggtttccccatgaggatcaggaagtttccacaatgagaagaaagccatttggggaaccctgtaaaaaactagtgtgttaaggcattatgtaaatatgagagtggataaatgacttagctgatatgtacagcaaagactattctgattatcaacttgggagttctagataaggtgtgtaatacaattgttttcaaactcttttgattgctacctgcagtaagaaatatgttttatatcacaatccaaaacacacacataccatgcacacagtatgccatcaactccaaaactctgtcagtcgtcagtcaccattattttaggtatcactaaaaaagaaaaatgataccaattaaactatgccattccattgattatagagctcatcttgggttcagggaaattaaaatgttaaaaagtgttgttttagagtcaataaaatatggtatatgtgtgtgtgtgtgtgtgtgtgtgtctgtgtataattgaaacaaaagtgtcatgaaacaatgctcacttttactatgtatggtatattataagtatctgctattttcccctattctaatctaatgtattttattgcaaataaagctggtcccactaaatttatggaatggctcactaatgttttaatttaattttaaagtgttaagtctgagctatagtattgttttgaaatagggaattggaaatgatacactgagattgatttcttatctcaaaccagatgtcatgctgtatgttttagtcatctatttcattcaaatgtaaattgatggtctactgtttaagttaggactcttgatggcacatgacagaaaccagtttcgaaaaagctttgaagaaaggatgggcttatcatcttatgttagggcagaggtatgcttgtggggccaagcaatactggaaccaagggctcaaatattgtgggatctctctttctctctttctctgttttgtttttgcttttctttgatggcttcattctctcgaattagcattctgtatgagatttaatctttgtcgttggcagcttcagggctcacatcttcctcattttaccaccagagaaaaatccttccaagattctcattggttcatgtaattggttcatatgattgctcctgtagtcaagggataggataaactcacctctactagaaccacataggtatgaggaataatgcagttttccaaaagaaaggctcttctttctttgagaggaacacaatagatgtctatcacacctaggaagtgctagcaccaggcattgtgtgctggggtgtagcctcacacaacaggtattgccaaaagcctgcagatgatcattttgaaaactagaattgccgtcagcttagttgcaccttcactttcccactagagcttgagtctcccagtgaagataataataactgacaacagctactgtgtgactatcagttcaagggcaccgaatggagaaatcggtgctttcaagagagaagctacccagaaaagaaatgattctacctcccaacacaggcagagctggataaaatagccatctgtaaaaaacttcaagtaaagtccaggtttttgttcttgggtgctcgtgttctattccctgttggggaaccggagaatgttttataaggaagaagccttaggtttcagctgagcagactgcagcctgtcactttcaggcattctcatgatgttcatttcagtgtttcagtgctgttttctggaaatatctttcttcacactctcttctctctgtctctctctgccatttaatgtactatattaaaatatcaatctacagctggcaattaaaagtttgctgcctacaattctcagtacacactgtggcgattttattttattttcttagactctgtcttctctgaattcagttattctcagttttgccaagatgtgccagaattttgtaagttatactgctgggttactgccaagaacgacgtaccagtcgcagctttatttgggcagctttttgtgccttaaatacagtatctgtttctgtaagtacagccttcactgagggagatggatgtctcattctgatattgatggaacagcttgagcatatcagtaatgtgtaggctaaagtctcaaggggaagaaaacttttgagagcctttgttagtttcacaggggcagtaaggggaaacaaaccctgaccgtattccctgaagagtttgatgtctagctgggaagaaaaaactcgaaatggcttctgaaaatccaacgcaacataaaatcagtgctgatttaaaaatgtgaacagagtgcatcaatgtgaatggaatggttaggaaagataaactgggggagctaggctttgaaatagctttaaacacaagaaaggaactgagaggagggaaagggctttcaggtaggtttctgagtcatgaagacagaaacaaggagtgaaattgcatgagatttagaatcagaaaagttcaatccttgttctcctataactgataatcacttcattctctgagctgagaatacaatcataaacaaagtgtcaaagagttgttgccctccccaggtttacattctagtcactgaatgatacctgcctcataaggttgcactgaggacttaaagaggcaatggaaatgaaagaccaggcagatttttaaaatgatgtgccatggtaatttgtttattgccaggtgtagaaggaggagggcaatttgatttgcttgactgctgttgtcccagctagaggttgaggatgggagtgttctagggtaacataatttgaaaacaggtactatgcccttctaaacacttctggtgtcccattttacagatgagcaaactgaggctcaggaaagaaaagtggcttcccaaatcaggatggcactggaacttaatcccagggctttttcagttgcatcctaccagagaggatggccatgagcagttgaggaaactcagtgtctgcttgctgtttcatgggatataacatctatgccctgaacaaatcagataaaagtagacttctaccaccgatcccccaaaggctttctcagattttcagattccttcattctgagggaggaaaccgaattaacttaacaaatgtaggttttcaaagtatttaaatcactgtttttctaatacttttgacaagacccacaggaagaaatatattctactgtgacctattgttagagtgaatatattatttattgtacaaatcaggaaggttttgagtgtgaaagagaatgctattaataataatgttagatggtaaccatgtgaggtgatggatatgttaattagcttgattatggtgattatatcacaatggatacgtatttcaaaacatcatgttgtaaaccttaaatatatataattttgcccattataccccagtaaagctgaaaaagtaatgctgggacaacaggcataaaatgggactgtgctatgcaaactggggataccctaccacacatacacctatataaaaacaaaaattgtacaaagtaaggtttattctttatatgtgcagtgcaccctgacattttcaattctatttcactacaaaaatactagtcatgacctactaaatggggtcaacagtttgaaacatactattcttagttgatggttggtatcgctgaggcacttatgatggtagtaaagacagggatttggtaagctgaatgtctgatatgtcctataaacttgtttcatctgaacattctgttgaatcttctgccacaagaaaagcactggtaataaacattttcttcagttcattccccatgattagcaaaaggtttagactaatctttctggatccctttgttccatttggaacaagaatcttcctctgtgtatttcccctcttttcttactcttgcgcttttatctattagtctgccacttatttagggatgtaaggaatccaaggaagaatgtctcatttacagatcctggttctctgtgtacttgttctgagccttcatcttggggttgaagctggtgctctgaaaagctaaagtttctttttcgctctactccttcaaacatatacacctttacacacaactcctggacatctctcctctgttgaaactttgccaagatataacagaatagatcttgcctgctagtcaggcatacggaactgacttctgggcttcttcaaaagcccccataaattaggactttccagaagagaagcttctgcagatttagctatggaggagagaagggttaccactgtacctgtgtccacacaagctatggacaggccctttgttagcccatttctgtcactagaaatgtttgtacactcacctgtgttaacaagagcttcaagaatacaagagacccggcaatagcacctttcagcaataaaataacttttggtgagtccccattttgtaaatgtttttaagtcataaaggcatatagggaaccacagggtttttcctacctcaaagtgtaaactatggtaatgtcttgagcctaaaaatcactttttcctaaagcaaattttattatctggatcatctgaactcatagagtaaacttgacaacagtttacttttctgaaaaagattgactgtatggcttttcctggtggttattaagatgaatacatatacatatgtttatgaaagattttctaaatcacaaatcatacaggattgttagaggaattttaaaaaacacacagaaaactttggaagcactgagattcttgaccatgtttcatgcttaaactttaaaaagtatatcatgccagatataagtttgtcatatttttacattttttcaagaaactcatttacacagcagctcagggatgtggaggccttcaatttatactcacataattaagtagaaaatgtgattatgaaccctcaaattagaaacttgtaaaactaaaacatatatattatgccatttaatttatggcaaccctgttgaggcatgcctaattggggtatttgaggcttagagagactcagtggctctcttagcttggtttcctagaagcaaagcttatggtttgttgagggaatactctcaggaaaaaaacctataattgaggaagggaagcaagaaagagctaagcaaggatagagtctcaggtaaattctagcaccacagggttcttagaaacataaatactgcaaggttgtccttccactcacctttgggggctagaagtctggcttcatgttcctccatatcaatcaaacattggctgcctccaggaaacaggtggggaggaagaagtggctcctatcagctgaggacaattctctggagaagagggcaactgtgagttatttgcagtcaaaggctcccagcagctaggagatgggcacaccagcctgagtaaaggggatctgattgaggaataagcagtatctaccgcagtgacctaagagaagactattaaaccaaggctgagaggtacatcagaatcttctgactttaaggcaaatgccctttctttttcccttcctccttttgtactttctactcttcctacaccttttcctccttttgttttaaaaacaaatactgtttattatgttagaatttttataagtcaggatctgggcatggtttagctggctcaaggtctctcatgaggttgcaagcaagttattggcttggcctgcagtttcatctgatggctcgacttgtgggtgttatgtgtgtgtgtagctggggagatcttcttataaccttacttatgttattgttggcaggcttttggtccctcaacacatgggccactccacagggcgccctcatgacttggcagctaacttgacccggaatgagtgatccaagagagagagtgtgagacagtattcaagatggacaccacagtctttttataacttgacttcaaaagagatatggtgtcccttctgccaaaatttattcattagaagcaagttaataaattcattccacacttaaagtgaggagttacaaaaggttatgaatgccaggggacagggataattgggggccatcttagaagctgcatatcagagtctaccctctggcacccagtgattatttcccaccaacatgcaaaatatactcactccccccccccttttttttttttttagaaaaatagcatctattcacagctaagcagctcactgagcctgctttctgacagtataattgtaggggatcaaagacctctccttattccttaatgtctctgccttcctaagtcaagctagtgatatttcagcatatataactcttttaagaattttgtgggtctcctgtgaatcttcttagaattcactctattagacaaaagttcaccctattagccaccttacaaatctcatagatatagactcttctctgtttgattgagaggaacttgagatacccttaatctctctaaggggccttttgtaagactgaaggtactttaaggcactaccttgatttaacaaaggattttacagccgtaattttgccttcatctttaaatcatgtttttctggcaatgccttggatttgatctttgttcagaagctattcaaatgtccttcatactgtaccacagctgctctgtaatccattggcagatcatttgttagcactaaatcatctggctcccacaaataaacaccctatggcttccaatagtacaaaatacccttttgtaaacatccaaatctgcagtattgtcacagtttaaatttatatacggaagctggactgattagaataaaaccatccaaaattataagcatgaggacataatttatgtgtcacaagaaatttaaggcagatttttctcttttttctccaacatttttaccaattccaaatcatatactgggtatacaaggtaaattagacatagttcccacccctgagcaatttatagacatgatttatctccatagaatacttttaaaaagttaggtctaggcctgtgctatccagtatggtagctattaaccacatgtggctatttaaatgtaaatttaaattaactaaaattaaatgaaataaaaacattcacttctcttgttttactagccacattttaaatgcttaataaccacataggactagtggctgccgtatttgacagtacagataaagaatatttccatcattgcagaaagttgcattggacagcactaatctagaagaaaccagtatgataagcatttatcctttttaaaaacatatttgcttctctctccccaacactaaaatgagttaaatatcaaaaagaaggacactacatgcttcttcagtaaatattctaacatgcttaacaataaagaatgctgtaagaccatggcttttaaaatttattaaaatctactgaaagctaacatctttttcccctagaaaaagcatgctagtaccaaaaggcatgtatcaaaagcatgtaccaaaaaacatgttcaattacaaggggttcatgggccctccaaagccctttcattaattctgtagtaggccatgatcctcaggttaagaatccctactgcaaagtaaattttattttcccattgactttcagtataaaattgatggtgcaatttactattaaatatgcttctttctgacaatattaaaattatgtctagaataatgatgaagggagaaacaaaatgtaaagaatgaagaactgtcttcaaaatgactaaaaaataaacccaacactttgagctaaaaatataatacagagccagcaaatctaccaatttgggtcaggtatcataatcaataaagaactatgtagttttagcaaatttgccaagttttccattagtcttaaatctctaccacatccctaccttacggtgagaaaccttatggcgtgatagcaggaacactctactagccttcagaaatctagtctcctgatgtaatttcaatacatataataagtattatttaagagtgactttggtgcctcgatgatcttatctacctggacattcagaatgaatgggtggggttccataggccaggaagaccctaatttgaactttggaaaaaaaaagagtggctatttctttgaaaatctgttgaattagagaaagtttttgcaaggagagcaaaattataaatgcagttggctccaggtatggctgagagacagaatcctacatggctctgagtttctgatttctgagccaacgtacaatttgtatttgtgtggaagaagcactgaagcattctttccagagtggtaatctgaaccatatgtagactgattaatagttatgtcataataaaacctcaattagcagaattctagagggatagccttttataaataaaggaaagtttactaagaaacctcccttctcccatcctccccaacttctttctctatttttcttccttttgaaaaattttaatggtggggaaaatctttccccaatgtacataaagctcctctgctgctttagtaagtacagtctactgaacataagtgagtctgtcttcgagcttattgtatctttcagggtgtctattttgcagactagtcatcatatttttatagaagttaatatatgagctcaggctgaaaataaactggaaattttctgagagtggcagctaatacccatttattttcttttcacttaaaaaacacctatcaaggctgagggcagtggctcatgcctgtaatcccagcactttgggaggcccaggcgggcagatcacttgaggtcactagttcgagaccagcctggccaacatggtgaaaccctgtctctagtaaaaatacaaaaattagctgagcgtagtggtgcatgcttgtaatcccagctactcagtaggctgaggcacgagaatctcttggacccaggagatggaggctgcagtaagccgggatcataccactacactccctcctgggcaacagagcgagaccctgtctcaaaaaaaaaaaaaaaatctatcaagaatatgcagtaaagttttcattcatttgtgtatcagtttatatgcatacagttgcatgtaacaaacagtgctattcacagtggcttaaattgaaaggatatttattgttgacctaacaagaattgtggaggtaagatgtataaggttgatgttgtagtctggtgacatcatccaaggtcctgggttctttttatctatccactttgccatcctcaactgaaaatctttagtcctgtgacatcttaccttgtggttgcaaaatggctgctccagcttcagacgtttatccttacacaatagcctccaaagctgaaaggcagaaaagagggaaaagtcttctccttgcgcagttttctcttttatcagggagaaaaatctttcccataagctccctccccctgcccctaagcagacttcattttacttgccattgtccaatattgggttacatgcttatccctggagcaattcctggcaaaggggaattaattttttgacttaagagtcatcatggttcatcgtttggggagggacacattgctgctgaacacaacctgtgatcttttagtaagaaggaaggggagaatggctgctggacaggcaaccagcagcttctgctacacatggattcttcattttgcttctgtgggacccactcttggcatatttgttctcacactactgaagaagccatttgctgtttgcctatcagtgatcccaaagccagctatctcatttctttgaaattgtaggcgcagaaggcagtaaggcctagtgaaaaaagaatgatagatttgaaggccaggcagacaggattcgaatccctgatttaccatttactggctgcataaccttggacaagtaaagacgttagagacttggtttccctaatgataaatctaaaatagtaccaaatggccagtgttattgtatagatttaatgagatagtgcatagaaattgcctagcatagtacacatatcataggcacttagtgtgtgttatttcctttcccatgtgaattcaattgcacagaaatcagattgcatttagcttagcagatagaccaattcggaaaaagagtaagtttgactccagtaggttttttttttcttttttcctccttactcatctatgttcacataaaagtcccctctcttatctacaaaagacttgtgggtagaaagcagtgtgccctgtgttagggtagtgtccagttactaagagaaagctataaaaccatatattcatttcttaattggtttgcttaaatatctgttaggtttaatataggaaacagaatcctctctaggtattttatgcaaaaaatgatttaatgcaggaaataaggtactcacaaaattggaagggctggagcaatggaagtcaagaagtctgcattaaaggtcaaatggcaccatgacttcagtccagatgccagaaactcctcctatcactcaggctaggaaactgttgctgccgtgattatcaccactgccaacgtcactatcctccctaccacacaaagctgatgaggggacagtggacacagttgacaacactcacatctgctgtagcctattttctgcatgcacaactgtagaaaagagttccttccctttgattccttccaaatcactaaaagtagaccctttcacaacctagggataagggaatctagaaactgtacttttcaacccaatgccaggctttcttccgccttacccatgtgaaagccctccttatcttactaatctgtgattcccctgctgggctatctgcccatgtgcattctctctttgcccctgttttccctctatgccctgtttgggctctgacatcctgctctggcctaccatgcctccctgtcctttctggtacagatgtctgccttgctctaaaggccttagaactcagttgttcaagaagagaagattaggaaagggtaagaggtctccttgctttgttaaaaattaccgtacatatctttgtatttcccaacaatttagtgttagaagtttttgaactttataaaaaaggagtcgtatatatagtatatagtcttctgggaccaactttgctcacaatattattttagttttattcatccatattgttgttctcacacatgagctttgccatattttaaaatcttaatgcatttttgcattttgggggttatgcttctttctttattcattcagcattctataatattttcccatgttaagaaacctcttcaaaatgaacattattatgttatgaatggatcataatatgattgaccatttcttgtagttggatatttaagttaattcctatcttagaatgtggtagatgaagaagatagaagaaaaaaaggctgagattttccatgtggcagagtagctggaagatggttatttgctgaaatgggaaacactgggggatgcacaaatttggtgataagaaaaggaatctggttttgagcaggttgagtgtgagtgtggagatatccagacaacagttgaagattctagcttggctcttaggagacagttcaaggctagaaacaatggatttatcatcagtacatggggaatggtttgaggcaagtatgggagtgagatggcccaggaaaatagtctggagatatgtaaaggaccaatactggactcctgggaaatacttatgtccaaatggcaggctgatctagatgtgctgtccagagagtctgtttagaaaggaggaagaaaatcgggaaactgttgtcatttggaagccactgcagaagagagcttcatgaaatgaatgggtagtcattcatactaaatgctgtaaatactgtagacaagttaaccaggatgacaaccgagggcaaaatatatgtatgtgtgtatatgtgtgttggagggctgggcggggggagaaagcttgctgctcatgtatctggatttttttttaatttggatgattgaaggttcacatgcagacatgcagttcaactgtttccttgggtagattcctagaagtggaatgacttgatcaaagggtttgagcataggcctttgattcatgttgttaggtaggtttcctggttttcattgttttttgttttgttttgtttttgagatgggttctcactatgttatccaggctgttttttgaactcctgggctcaagtaattctcccactcagcctccctagtttctgagattacaggcatgagccactgtgtctggttccagtgctcatttttttatatgcaatgatgaatagtttgtaattttgtacacatctgggtgtgcagagacaaggtgaggaaatctgcagcaaaggaaaatacagaattgggcttctgtagttgcgggtcttttcctaatgaacacagtccagccctcatctcctctccactttcagtttccacactctacatctctcatccagaacacaagtggaacagggaccattactcattagctgcatggggatttgaataacctcacagtggaggatgttcttgtctgttatggtggcaagtaactacaactaaatgcgtgaccaagacagagctaactcgagtcattaattagactgtgaagtctggagggaagttctctgaatttaagattacagttttgaagtttggcatctgctaccacttcaaggattaaggatttactgctcactggaattcaatatttaatattttaaaaaccattcagctccagcttgcaaatgagttaaattaaaataatacacagacgttctctctgaggccgtggtttttattggtagcaacgctcattaagaaattttactggctgggcacggtggctcacgcctgtaatcccagcactttgtgaggccgaggcgggcagatcatctgaggtcgggagttcgcgaccagcctgaccaacatggagaaatcccgtctctactaaaaatacaaaattagccaggcatggtggcacatgcctgtaattccagctattcaggaggccgaggcaggagaatcccttgaacccaagaggcggaggttgcggtgagccaaaatcacaccattgcactccagcctagcaacagagtgagactccgtctcaaaaaaaaaaaaaaaaaaagaaattttacttgagccatacgttcatgagaggttctaaataagcacacagatagtctatttcagccttcatttcctacaaatgctgtatatagaagcaactttgtgtttcttttgtcaagataagacatttgatttacctccttatcttgcatttaaatttatttcacaagatggacctgttttcaggtaccataaacacccagttctactgggttttctttgactgctggggaaactgtggactgtgtctgatgcacacattttattgcatctcccctggcatgagattcatatacattggcatcttctcagagtgaagttgactctctctgtttccctattccagaatttcacttggcatatggtgattccaaaacagtttgaggctcattttgcttggtttttggcaatctcagctcagccggtttcactctgagagatctcctgtttgttccttcatgaatggccacagaagcttttgctcttggctctgcattctaatagcacctcctgcatggtctgtggcaaaggaatgctttgaaatatgcgtccatactatgtggcttttcttgctgcagtttctgttcttttttattgtaggatcgggagactcaccactagaagacgatgaagtcgggtattcacaccctagatataaaggtgaatgctttgcttatgtgctaatgaggacctgctggtgccaggagaactttcctttttgccttgtgaaacagattgtaataaagtgaccagacaacacatttaagttctaattatctatcaaggaaaaaaaaatatatatatatactcccttttttaaaaaaggaaataaagcaaaatgcattggaaatctctgaaatgctgtctttcagcatcccaatggtcattttattctcataagtttctttactgtcctcacttctgcaaaggcagctgtagctgatgaaagtgaaaatcaagcctaattcatacattacagccagaatcatccagagtaaaccacctaaggtcaaatctggaccaagtgctgataatgtactaagatgaatggggaaggagaaaacttgattttcataagctcatttcatcgtgctctttctgagcccagcatggcttctgaaacggtatgttaaagtatgttgctcaaatgaaacttaatgataaagaactccatctctacatattcccagcaatccactccccagcacgtataaaaagcctaaacaagaaccttctgtccagactcaggtaagtatgtccacaaatatttctactggtgaaacatttctctgaagcttagggaaacctgggagaaatgaaggtaaatttagagatgctttctctctgaatctagttcctcttacagtggaggaagaatttgaaaaaaaaaaaaaaatggttaacaaagtttcactgcggcattttgccctggaaatttgtcctaattcctgggatgaggacatggcccttgtttgttgtgatgtgtctcagatacaggagaatcagggtaggactggacaacttttgactggagatgtccttcagttgttttctacacaagtgaacaatatttccaatataatgactggtgcctggtgcttatgtgcaggtgtgcttcccatcacataccacatttttttgtgagatctgaatgcaaatactcattcctacctatagtttctatctccatagcctcaggaattaaccaatcaagcaaagcacaaatacgttaatcagatgcttggggtaaggaaaggttctaattcgcaaaacttcttaactatttatgggtttagatttttttttctttgagtcccttgttgaaaaatcttcctaaaacacatgcatgcacagatgacccttcacatctacagcaggggttgcctagtgccctcaggtccttgttcttcacatccatcttcacctcacagcattgcaaatgtgacaggtagaccagatggccaaaatgtgtgcttgccctagaacttaccctgaatgtttaagaataaattttcttagggcattgtttctattgtcagttaaattgcttactggtagcaatcatttcagtatgtataagtatatcaaagcatcatgttgtgcgcttcatacaataaaatttaagttttatttatttttattattattttttgagatggagtctcaccctgtcacccaggctgtagtgcagtggcgtgatcttggctcactgtaacatccgcctcccaggttcaagcgattctcctatcttagcctcccaggtagctgggactacaggcacacgccaccacacccagctaatgttgcatttttagtacagacaggggtttcactatgttggccaggctggtctcgaactcctaacctcaggtgatccacccaccttggcctcccaaagtgctgggattacaggcgtgagccactgcacctggccaagtttttttaattttaaaagctagagacaagccattattaagtgagggtttagttttagatcctgaggcccctgcacaatgtccagcacagagtaagtgtttttgaattaaagtaaaataagaaagaaaattaaatgtaaccaacatttacggtgctcctggtatgtggcaagcatggcttttgattcttttgcttggaataccatcatatattcatattaattgagtgagtttgtgatgtatgagtatgcaggtcatatatatacatacattagttcccccttatctgcggtttcactttccaaggttccatttaccttcagtcaaccgcagccccaaaatattagatattttgagagagagacagtacattcacctaactttcattacagtatattgttataattgttctatattattattagttgttgttaatcttttatcatgcctaatttataaattaaacttcatcataggtatgtttgtgtaagaaacaaacagtatatatagcgttaggtactatccaaggcttcaggcatccaatatcccccgtgggcaaagggggagtactgtatatcacaaatatatgtagtacatacagattatattaaaacccttagaggaaggaaaatttattcaaggaagttctttaggccttgtgtgagctcctacacgtttatatccacatggttaaatttaatcagctctaggttaagcctttaggacatcacctttacctagaaagtccagggaagattacttgagtcttgagtttagggctcacttgcagctgtctgcaaaacatgatatgacgaaagtattagccagaccagggacggtggtgcgtgcctgtagttccagctacttgggaagctgagacaggaggatcacttgagcctaggaggccgagactgcagtgagcaatgatcatgccactacactccagcctgggtgacagagtgagaccctgtttctaaaaaagaaaaaaaaaagagaaagtattagctgaaggaaatgtgaaggcaaaactaaaacagtggtctatgcataagacgtggccagaactgttggtttttgtaactgagaagcagttggaggcatatcctcagaagagaattcctgggaaagtaaaacagggtctgtcctccttcctggccacatgatggcggtcttacctcactcactgacagctcaggtgctgggttggagtgatgagccaggcagttgcagggaagtggctcctattcatggcattgagagcccggcaggctttagggaactcctcactgttccccatcaattgtgggacaatggggcagtggctgctgtaggaacttatccaccaaggagctagtgttgcccttatattttatggatctcaaagagaacatttcaaaagcacagcagggaggttctgatttattcatttcatcccagctgtgctttgggcaactatgagaccaaaatcaaaacacctgcaactttgccatctggggagggtgtcaccctgttacgtaaatggggcataactggggacacttctctatggagagcaattgttctgtgactttaagcgaaatttatatcttgttacaaacacctggaaattgtagcatcatttagattaatgccagtattacaacattttagagagaatgtgcatacggctcagacgaaatccaaattaaccaattattgaatccctaccgctatgtatgacatcagttgcccttgaaagaattatctaaaaaataaaaataaaaaatcttatgtatctagttaagggaaatactaaaaagaacaagcatttattgaacatatatgctaggtactgtgctagatgcttgatatgcaatttttatttcgtccttgtaacagcactatggcataagtatagatattgactcagagaggttagctaacttgtctaagatcacacagtcagttatagaggaactcagattcatgttcagatatatctgacacttagtcccatgatcataacctccctacccggagacacctaagaaaacatggggcactaattgaaggtccaaaatttggaatgtagccagcctgggacagtaagagtaaggggacacattttctgaaagtgtcatttcatatttatctcctcttttgtttctgctacttgtagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacgtgagtaggccagctctgtgttgggtcctcagggatgaccagagccaaagttcttttgctctgagattgaggattttcactgaatattgatgagaaaaattctccttatgatcagggggacaccagggggattctaagatatggtggaagtgagttggctcctctcagagagaatgatatgatcagctgtttgagaaaaggggagagaagatcattgttcagaaaatgagttacatttgttcagttagtgctggatcctgaagaggtgttggggatttagaaacaaataagacgcacatgggtcctgccatgaagaggctttagtaaggcagaggtgtcaactgggagataagtacaagaagggtacaaagtcagggacatatggtagcagattaaagaagagttctcctggctgggcgcagtggctcatgcctgtaatcccagcactttgggaggccgaggcgggtgggttgcctgagctcaggagttcgacaccagcctgagcaacacggtgaaaccccatctctactaaaatacaaaaaattagctgggtgtggcagcgtgcatctgtaatcccagctactcaggaggctgaggcaggagaattgctagaacccgggaggcggaggttgtagtgagccgagattgtgccactgcactccaacctgggtgacagagcaagactccatctcttaaaaaaaaagaaaaaaaaagtgttctcccaaggagtggggcttagggaggcaggaaagagtcacagaagaagtgatgcttatttatgaaagtgagtgtgcctcaagggagaagcttagaggagcagcatttcaggggctggcttttagcttcatgacaagtcatacctcatttggaaaattgcaagtggtacagcattgttgaagcacattttagatgtctttggtattcaaaacagccaccactttttgagcgcttatggtttgccaagaatttcacatacatttgatttttacagtaacactatcaatatgggtgccattatgttaacttcattgtcagggaaactgaggtttcaaggctgcagccatgtcatcgagactatgcagactctgcaactgggtgactgtagtggacaatctgctctacccagatctcctcgatgccttttactagttgtatgtatccagtacccagcttctgagtactttgctcttaaagacttggaacttcaaccttattcagaagactgctccttcagaggactgatcccactcgctctctctctctctcactctctcactctcgttctcttttcacaagagaaagcatctcctgtgagcagcctgtagctgcccaatgactgactgataaagaattatgaaagcccagcttccttgcctgggggcaggacagaatgagctgtcattcacactccagagcttccctatgggatcaggctgctgctgactttgcctgagatctcatcttgcctggatttctccccttccctgttctgctttcctcaccccctcactagtctccctgggagcactttcttactaaacctcatgcacataaatccgtatctcagaatctgcttctggggagctcaacctaagatagtggcttagctgggttgccaacccaagccagtgtgacaggaaactttgtgtcttctgtgtgacataaaaccatccattgtttcttaaattccatttgttttatttatttatacaaagtcgtgttcttgttgcccaggctggagcgcaatggcgcaatctcagctcgccgcaacctctgcctcctgggttcaagcgatcctcctgccgtagcctcccgagtagctgggattacaggcatgcgccaccacgcctggctaattttgtacttttagtagagatggggtttctccatgttggtcaggctggtctcgaactcccgaagtcaggtgatccacctgcctcgacctcccaaagtgctgggattacaggagtgagccactgcgcctggccttcttatatttaaattaacttttcacctcatgctttcagagtttctagactctgaaatgaaactctatagacaaaaactaagaaatgctgaatatctgattttctcattttcagaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtgggtaagaaaatgccacagcccttaggaggcacttgctttgggaggagcagggggtgttcacatcgtggattgtaaagggagcatcactattcctcctgtaaggcctaagcatgcaactttgctctcagtagcatcactggttctctggctcagccctagatctaacctcagtgtctatcctggagctgacttcgtagctgatggcttccatctgacttttgtctttttcttggtttgctattgaggcaactacaggctggcagagatgtggcatactcctgctgattttagttcgggggcctgagcaaagttattgacactatagggacagtccagtagagaacatctatgtgtctttcagccccaatgtagcttctttgtcattgactctggtggtcagcaagcactcaatttgttcagctggaagggatttggatattttgccttactctgggtttgttgggcagtgagtggttcccatggtgtggtcctgggagcagaagcagcagtagcatctcctggtctaagaatgcaaatttttaccaacccacccccaccacctgctgagtcagaaactttaggggtcaggcacagcattttgttttttaatgagcattccagggattgtgaggcactcaaatagagagctactgatctaaggcactgcttctcaaactttactgtgcagcgaagtcctctagggaccttgggaaaaatgcagatttaaattcagcaggtctgcggtgggtcctaggattctgctaaacgatgctttagggcaaagtttctgaacctcagcatgatggacatttggggccaaataattctttgttgtggagccctgttttttttgtttgcaggatgtttagcagcatccttggattttattcactaagtgccagtaacactgcccacagggggcacctcacagatgttgctttcaatatcctccctgtgattagctatgtgcatagctcttcaaaacaaaccaaaaagaaaattgaatctactccctcatattggaaggggcagaggtgatggtgggaggagagaagctcaaaaatctttctgctaagcaagctttggcagagtactctagggatcatactgtttaaatttccagattgtgtgcaacaatggaaagaaaatgctgattgttctcaaaaaccaacagcatgtcttaagctggaccagatgcgcctggaaccttcccagaggaagagagaatgaaccccaaattcaggagattcatattacagtttgtcagaacaaggttcaggcatatttgggagaaggaggattgtacatgcaattagttagggatgacaaaaaggggtacagcgatccacaagagagcctagagctcccaggaaaaaagagagaaatgggcaaagcaagcaggcaattctttctttgattttcgcgacagacaagctgaggtttgtccccagtgaattttactccaggggtattatttacttttttggctttaaatgtattaaaatagtttaataaatttgtttttgtgttgacaggggtagggggtccttgagcgtaactcagaacttcaacctattttaggaggtgacacatagtggctaagtagttcccagatttccacacaaccttcaacagtcttggccagagctgtactgagtggtgagaaagttgtcccagttctcttctagactgtgagggaagagagaagactgggcttactttggactctgaggtggtcagttctgtggtctggctaatttgaaggtgccacaagttaaaattaattctcttacacagaccatactctggcaatgagctgaaattcatagttatttcagaaacagatatagataaaaataagtcaatgtaggaggaaaaaaaatactgcaaattgcaggagggtaaaaagtctttgaagagccacaacctccattgatctggaagaaaataaaccttagaatgtaaccactattgttttcgggggatatttttctttctttccatttttagttatttttggttatgttggcatttagatagaacaatgaacagttggaatcacaacaagtcctcatgtaaagaccagattttgagtagacacatgatctctcctttagaccaacacttcttcctaggccaaaacaggaagaaaacaaattaaagatactttaaaaaccacggacaatgaaaaaccagcaaaggtcttttgacattcagagagtatccatttaattactttaacaaaagacaatgtacaaactttcctttttgccctgtggaacggattgtaataaagtgaccagacaacacatttaagttctaattatctatcaaggaaaaaatatttttaaataaatatattttattttttgctcacttattttttgttttctacagagtagaataggtggagatttattaacacaaatgaaattctggaataaaacattttggagatgtaatatatggaaattgatggcatacgtttcttgtgtcccagctgtctcacagctggtttacccaatgacccataggaatgggatcattgcattattgctgggctgcattgcattattcagttgatgcaaacatcagtagggctaagaatgaatgtatccatgcattgttgcaaatgatgttaaattgtgctaaattcttcctgggttgacaaatacacattcttttgcaaactttcagaggctagtttcagttaaaacaacttgattgactgagatactgattcactttttcccttacatgatttgttagtacaaacagaacaggtcaacttttagtggctctctctaatataaatgtatcaccaatgaatttttatttgggcttctttcttgtgaagatgttgacttttagagatgaggtctcattatgttgcccaggctggcctcttgctatgtcgtccaggctggtcttgaactcccaggcttaagtgatcctcccacatcagcctcctgagtagctggggctacaggcatgagccaccacacccggctatgatcatgacttttaaatgtggatttcattgcctcccttcttgcctcttttgtctgttttggaaagttctctggatttttgtatggtgccaaacagaggaaaccacttcccagagccatccacagagattacgctctggctgggggaagcaaacaactggatgagttttcaatggccaggtttgttctgcatttggcagtcactcacttcctatgcccccttgaaaagaactcttcctttctctatcaccaaactcaaactattttatatttgcatcagtgatctgttgctgcacaatagaccacacaaaacttagtggctccaaacaactatgttattgctcaaagattctatgggttggaaagttgggcagagctctgtggggacagctcatctctgctgtatgtggtaatggttgaggtgaccaagtggagctggaggattcaagatggcttcactcacaggtctggtacctcagttgggaaaagttgtactgactggggtctggctgagtctctttctctctctctctctcatttataatttctcatcctgattacatggcctctccagtcaattggacttctttagatggcagctggcttttaacatagtgaaagcagaaggcaccagattctttgagggcctaggtctggaactggcacagggtcacttcccttgcattttattgttatctgttgggcaagactttgtccttttgagcttcttccttatttccactacctaccgggttagatgtgtcaaggatttccaagtaaatagttcagcttcagctgggtgctggtggctcacacctgtaatcccagcactttgggaggctaagacaggcagatttcttgagcccaggagttcgagaccagcctgggcaacatggcaaaatcctgtctctacaaaaataaataaataaatgaataaataaaatcagctaggcatggtggtgcatgcctgtagtcccagctacttgggaggctgaggtgggaggatcacatgagtctgggaagtcaaggctgcagtgagccgatattgtgccactgcactccagcctgggtgacagagtgagagcctgtctcgaaaaaaaagttcagcttcttagataaatagtagttgatacaatgcaatatatttgtatctcatattttatatgcacagagataactagagcacagagaagggagacagtttgtcagatgtctccaatgaatgtggcagagagcaaaggccagaattttcactgaaggtttcaagatttttatataattgcaggcatcctaattcaacaggggatagtaattatgtttctatagtaactttgttcctttcattcatggaaatgtataacttataaaatgctatcggggccaagtctgggtaataacaggcttaggtctctggagcatcagctgaagggcagaccagcttgtctcaccagccgagagagaaggcagctgcttgaggatgtgtcaggatcaagtcctgcagaggctcttcaagggttcatggggaagctatgacagaccatcacaaaacagtatgtgtgcaaaggttggcggaaaacactaggtcagcagcaggcagatacacaaaagggtttggtttattaaaatagctttaaaatatgtaatggcatttaaaaatcccagaccacaaagaaattccaaaagagaggaaatgcttcttcccagtctataaatgaggatgctaataacactgcttagtctaatgggtggttgtgcaaattcagtaaaataatatagggagggtacttagcatggggtgggcatgtaggaaggagtcctccaatattagttattatttgtaatgatttatttcttcttgtttcttctttggaagagcactgtttctgaaaagctaggccagttcagctgatcattgttagctagagataagctggctttgggaaactctgagactcttcacccagataacctatcttggagcctgtgtgcttacactgttagtacatcttgatacagaaaacaaacaacaatgtatcatccagacatttagtttacctgacagagactaagttgcttttcactctgaccatgctgcaccaagaaaatatggtaacacaatgtaattttacattgaaatctgtatgctaataaatatactttctataatgtaattgccagctatatttgaccagcagggggcagtcattatatacttgtctttctgtgaaatgttcatctgaattataaaagtttgtcttctatcacctatcatagtaaaaaattaaatgtttttaaaaacgtaacagctgagtatagacatcttgaatgcatttaaagcatcttccatttcatcatagtatttgtatactttattttatcaattctgagaagcgtattatttctaccttttaatatccctgaaatagggatgcatttcacaattaggagtgacttagattcaacaaaatatggtggttattcaatttaggattggtgcattaaggctgttaagttcacactccactgaagcacgacatagaatgaaaatgaatttggatagctgaaggcaaaattgtttaataagttattcgtaacttcttaccctgaataaaatgagaaattattagacaagacacaggagaaagtatataaagaattttacttggtgcatttagtctctcaaagacatctgtcattcagaatcaaaaggacatttaactttcattaaggcagtaatagcacttaatacttatcagttgatatgtaaagtaacatgaagctgaatgtccttaatttgctatgccttctttaaatacattctctacctgttcagaaatattaagtagaatttgcagaaatgtgaacttcctcttgtgatttcacttcagctataagatgaaatacaacccagtgtagagttgacatctcatttactttgagccctcattaaccacccatccttgttatcactatcgaggcagaactcctattaccaggtagagaaactacttgaagaaatttgggaggcttttggaggtccagagccacagtaaaactgctgtcccagaacataaaaccataagtgtagttcagtagcagttcaaggggagagtggacccagacagaccattgcctattttaagatattaagcaatatgttgataatagatagcaggaagagagagagcttgttccagtggcaagtgctccgacttagattgtaattcacagtgccattatctacatgtgtggtcttaaataaatcatttaagttctttgagcctcagtttgcacatctgtaaaatgagagagttgggcggctcctctacacctccatagcattcacttttaccttgcctggggcaattgccattttctacctcatgttatatttcatgtgtgataatgtaatccctccaatacatggcaaattctctgaaatgtcaggagcacatgattctcttgcctttgtgcacccccaaccccagcagttggaatgaagccttggataagattggtactcatgaaaaatttgttgccttgaattgaatctgactagatgatagctagaatgcctttctgtaatattccatgatgctgtgttcaaagcaggaagtactcactaaagccaaatgacttctagtttcagctgggtaactgccatgtggccttcggtaggcagagtttggaagcatggggaggaaaggctgtaactaatgaattacccacaggacaccttgcaaggccagttgattgcaggtttagccctgcaaatgtgagtatttaaacaatcttcaaaacttagcaggagagtaaaagcattatgaagggagaaaaggggaatatatagggtgaacaaactctttgaaaatggagaatacccagaggctttggtattttaaactgtgggtgttgaaccccagtttgactagatatttcttgatgatgatgagaatgttttggttatattttcagatatggaacctcctagaatcaagtgcccaagtgtgaaggaacgcattgcagaacccaacaaactgacagtccgggtgtcctgggagacacccgaaggaagagacacagcagatggaattcttactgagtaagtgaaacttggcagataaaatgatgctgtctcttttatgtgagatgtttactacccagagtaggggagtgtatatatgctggtctatttatgctttcagatgtggtccccctggtcactacctaacatactatatatgtcacctatgtatttgttgattgcctgtctctattataatatgttcactgctatgtccttaatgcccagaactgtgcctggcacatagttagcactcagtaaatccttactgaaggaaaaaggagaaataaggggtggtgaatgatgtgattattatgcattgcatgcctgtatcaaaacatcttggctgggtgcggtggctcatgcctgtaatcccagcactttgtgaggacgaggcaggcggatcacttgaggtcagaagtttgagaccagcctggctaacatggtgaaaccccatctctactaaaaatacaaaaattagccaggcatggtggcacacacctgtaatcccagctactcaggaggctgaggcatgagaatcgcttgaacctgtgaggctgaggttgcagtgagccaagattgcaccaccgtgctccagcctgggtgacagagtgagacgccatctcaaaaaaattaaaaaaaaaaatctcatgtaccccataaatatatatacctaccatatactcacaaaaattaaaaataaaaaaaatgtaaaagaaggggtggtgagaagaagggaaggaggaacagaaggggaaagaggaagccagttggttaatttaagaatagagccacccccattgcctgcccaggcagaccctactcatgcccccaggccattacctgcactgggaagccatctgtgtctcccaggtggtgccaaaggctgccgctcttgtgctctgtgagtacagtttagtgcaaaactttttcaccccttgttttttggctgtatttatctctttcaaagctttttaatttatttttaaaactcccgatcatatcaaacacttacagatgcttatttaaaaaaagagaaggtatcttctgctttcttccccacctctaccccattctcctggaccaatttcattcatagtttgacatgtatctgagttgctttttgttggtgtgtttgttttaccaatcacaatgagaagcactgttaagaagcttttaaaaatgggtggatccctttgtgagggttagctatgtgttgttctaatctagcatttgggcctgtacccctgcaactgtttggttggccttcatattccctggagaccactacttcatgttagcacattcatatctgtgccttaaagtttatgggcatattagagttccccactgagttttcatctgtagatgaaaggatacctctaacttatctcctggtgatccataaagcaggaaaagactttctagaatcctatcaacccaggctgtgcatgacaaaacatttttacacaatgattagcaataacagtacagtttctagtgagaggagacaggacattttgttcctacattccaataatcttcccccagtgcctcatctagcttaagtagtattactagttatgctctcccattgtaacttctcaaagataaagtttgaccattaaaaaattatttgctgtcacatacacatcccacaaattcctttggagaaaatgtaggcaatcagaattgaaaagtaagttgatgttatcagggattgggttttatttacctttgactcttcagggtctagcacaatgtctggcccagccccagcacgtagtaggtttttagatttttgcagctctgactgctgttgaaaaaacctgtgtgataaacacaaaacatcaagccatcagatgactctatttgtctacaagctttgtgagaatattcaccttgttctttttatgggtaacttgcgtaatatggttaggagtgttacattttatttgatttttttattttttgagacagattctcactctgttgcccaggctggagtgcagtggcacgatcttggctcacagcaacctccgcctcccaggttcaagtgattctcctgactcagtctcctgagtagctgggattacaggtgtgcaccaccatgccctgctaatttttgtatttttagtagagatgggtttttgccatgttggccaggctggtcttgcactcctgacctcaggtgatctgcctgcctcagcctccaaaagtgctgggattacattcatgagccactgcacccggcaggattgttacattttaaaacagcatctcagtattctcctgtccctttgttcagagcagctgtctgcttccagagttctacaacccagaggccagaaaggcttagagcaggatgtggtgggaatgcactccaacaggatgaggagttcagagaaggctgtcttgttcccttttcgctctcactagggctccttgctgccctggcatttctcctatgaccccttccaccatttcctatccaagctactgctctatcgctcccttgtgagggagaaggttctagtgtcaagctctgagacaagtgcttcttgtgagttcccttatttactccttctgttatttgcatgtcacaggtgaaacaaagtctcagaaaggttacatccacttatatttgaagtatcactcctctcaggtttatctgaatttaaactgtgctttctaaagaccttaaagcatctaaagccaacagcagcatgtctcaaaatagtgggatttctgacattttcccaagacccctctctcatacctggtaaacagccacctcacccacctacatgtaaggctttcctcaatggtgacaatgataattccacgtgttcattattagcaaatattctcatcattcccagaactgtagggagatggggaattatatgtatattgaaaaacagaacgtggattttgatcctgctatacttattggtgtcctcattaggcagccaagaaaaaagataaactcaccctagctgtgtgaccttgggcaagttctttagcctttttgtgcctcagtttcctcatctgtgaatcagagataatactacctaccttatagggttgttggattaaataaggaggattaagtaaatatatgcaaaatgcctagaaccatgcctaacatgtaaggtttatgtaagtgcaaagaacactttttgtcattattattatgttattaggataaccaaggaatcacagagaacttgcctttaggtctccactgtcccagacagaaagaacagagaaagttctagcacccacccccgccccgcaggcccaaattgccagtgactgcttggactatattctctaatgattttcctcacagaaaattccctcgtcttcccaacagtgaggcaattcaggtcccccctggaacaagagtgagattgaaggaggagacttgggccctatatttttcatcctccctcccccctctacccacttccctaccattctacccttcagcaagaaaaaagtctaagcttcccagtagtttgggtcttccattttctggtcacaaactgctcttctaaaacagactaaagcttaggagattctattcttcaagaaatttttgttttatttaaactggtctaatggttgcccctcagtctctccatgtcctgtaaagagtaggggatcgtcacttgcttgtcaggtccataatgtcatctttcctgtttctgattttttttctctaagtgtcattctaaaaggcctccccccaggctccaactttccagaaggagaccacaagatccagtacacagtctatgacagagctgagaataagggcacttgcaaatttcgagttaaagtaagaggtaagagtactgcttattggttttgtttccccctctctttagaagagcaaagggaagtaggtcctcaagccagaactctctcaagtgcctactgtggtgggagacttgccagctttagattagtctctaataaggcttggggaagtgccctatcttaatgcctgaatttcacgatacacatccggatgggcgtcagtgttgccagattatttaaggagttcccaggactagtcttacaggatcccatagctgactgtcctagaagaatattattcaataatttttccatccctgagcttaggtggccagctgaagcctgtgagtccatctacaaccagggtgaataggagccccctaatttgggccaccaggagaacatgtttttagtgttctagtaccattggtatgaaagaaaatgtttttaaggattattttatgcctgatggtttgggcaactaattgctaaccatctttactccttactcttctggacttcacttcctcatctataacactaggggcgaaaccagttgatatcagtggtctcattggtatggatggtgaccattgcaagactcactcactgaccaaatagtcatccctcctccctcactcatttcacaggctgatgtagaagcctgattgcaaagctgatgcctctgcatcctcaccttttctgcttactctgtggatgggagctcagcactgagacccctctggacttgtgtccctacagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcaggtaggtatgccgcccctccagcctgcagcagaacctgtaaaccccttggttcttgattccagtgcaagagaggtttcccttcatatactttgagaagttcatggccatccctctttatctgagtggatgaacatagtccctagatccctgctgcagctcatctcatctgccatccatcttgcccctgcctatcctctaatttccttttcatgtcctctaaggaagaagctcaaggtaggaacctagggccagcctttggtgacattatgaatcagcaaaatttgctctagtttcctttgttctagaaatgtaaggatcttatttataaagctagtaaattgccatgtagagacaatatcatacctgctttgcatcactggcatgaaagttacatagactttgggcatttggaatctttcctcctatgtaaaatgaagaaaataatacctcatctacctcttgagttgtaaggattaaatgaggtcatctgtggaacagtggaatagagcagtgcctggtacaggcaaagccttatgccagctcttattcctgatgaagaaaaattgggctgggtaatgagtctgaaacttggactagccagaaaattatgtatgtatctcttgtttatagacttctctttttctcatttcctggcaccctttcatctttatcactttcttttaattgaagcccccatttagagttaagtgacagagagacatatataccatcagctaaatgcctgagattcttcaatttcatgtattaaagtagaaagaacacacctattatagactccctacctaaggacttcatgcccaccacctatgaggctattctgaattgagatatgctataagtgtaaaatatataccaatttcaaaatcttagtgtgaaaaagaatataaagtatcttaattttttatattgattacatgttgaaatgaaatattttggatatattgggttagataaaacataaaatcatttctacctatctctttatattttttatttgtttgtttgtttgtttgtttgagatgtagtctctctctgtcacccaggctagagtgcagtggcgcgatctcggttcactgcaacctctgcctcccgggttccagtgattctcctgccccagcctcccgagcagctgggactacaggtgcctgccaccacgcctggctaattttttgtatttttagtaaagacggggtttcaccatgttagccaggatggtcttgatctcctgacctcgtgatctgcacgcctcggcctcccaaagtgctgggattacagatgtgagacactgcgcccggtctctttacacttttttaatgaggcaactagaaaatttaagattaaatatagtggcttacattgtatttctcttgaccagagctatcctagactctgagtccctggggcagggaagagggcaggaaagagggcaggaactgtgtatcactcagtgtgacatcctagtacctagcatagagcttggcacatggcaggcactcagtatataatggctgaatgaatgaatgtgtgaatgaacaaatacttcaatgcaaacctaaaatgtgaaatatgaaaaccaagattataaatcatacatggcatctactagtttttctcttattatttcttctctggggctaagccttttgcttgcctatctatacgacatccttcattgaccttgaacagctggaattagttgtcatttatttgcttaaagggaagacctattataaaaccgccttgtcccatgtcctgtttgcctgtgttgtttgctctgtggcctttgtgccccacattgctttgtcccttctgcaccaaggaggcagacttcagagattctgagccattccaaagccagcctggccactgcccattctcttacccttctgcctctctgcacccctttccccagcagatactatggtgcttggcccatatgcctttcacattcccatctgtgttcaaaaggctacttactgcaattaactgggtctgtctgtctgagagcatttctttcctggctatgaaagcattgtcagcccatgcacagagccagctggaagtgatggagagttagtgccccagaagcagccctcagcaatgatggagcaattgtataaatactccagttccctccagtgggttaattctggaggtatgttgtatatcatctcctagagttccccagtgggagtgagttccaaatgcccacagcaaaaacttgcttgataaccaattggtattgttttctttccttcactgtctcacttcctgacatagacagaataatggtccaccaaagatgtccacatcctagtccctggaacctgagaatatgttaccttacatgaaaaaagggactttacagatgtaataagttaaggattttgaaatgggaagagtatcctgaattacccagtgggcccaatgtaatcacaagccttcttatataaaggaggcagaactgatgtcagagtcatagaaagagacgatggaaggagaggtcagagagaagagagatttgaagatgctacactgctgtctttgaagatggaggaagggactactagccaaggaatgaatgtggcctctcgatgctgaaaaagacaagaaatcagattctcccctagaacctccatgggagcatagccctgccaacaccttgattttagctccatgagaccaggatcttttagatcctgacctgcagtatctaaaagaataagtttgtattatgttaagtcactaagtttatggtgatttgttacagcagcaagaggaagtgaatatacttccgtactcctccacaggcgcttcttgggactgcctcccaaataaactgtttacacttgaatccttatctcagggtttacttcttacacaaatggttctgtgtgtcatcataggctctgttgagccagaacaagtggaaggtttctgacccatgtggccatttctgattacagccatgaacgtcaatgtgggtgtcagaacggcagctgcacttctggatcagttttatgagaaaaggagactcctcattgtgtccacacccacagcccgaaacctcctttaccggctccagctaggaatgctgcaggtgagtcctcgaggcagggccaaggtgagagggagacctttaacaggaagggcccagccatttcactaaaagcaaaggccagattcagtgcctaatgcacttacagtgagtttcaggaagtggcactttagagctaccaccattcatttctggttctgggccataacctgattaacattgactccttagagttaacccaatcgttttccaactaatgaggtttgtctgtcttcaccaataagtctaattgacatgctgtccaggcctagccacagaacaattgtctttgccaaacctgtccaggatatgcctggctggaagcaatcaattggttgcctgcccacatttttccccagggaatttctttgactcagagggtgacagccattttttcttagaaaagtggttctcaacgtgtgatccatggaccggaccagaagcatcagcatcacctgggagcttgatagacatgccaattctcagggcccctcccagacctactgtgtcagaatctacacttttaacaaaatctccaggtgattcctaagcactctaaagtttgagggtcacttttctgggaaatgtgtccttctcagctatgtaaattttgtagctactaaatgaggcaaccaacatcttgggtgtgtggggaaggctgactagaaactgtaaggatcaaactagaaattgcttgcttttgtcctgaggctggtttgcaaaagagtggccaacttcactgaatactaaagaggcaggatgtatgctgtgccatggatacagtgctgcacatttttttgagactattttattcatttattacagtggatagaactaagtgcttagaacagtattgatttaatcaaaggctacaatttacttctcatatcagcattaataaaatggataataataagtctcttttcactcttcccacgtacttgaagaattgcctatgaactctgaagagccatataaaatttttgtgagttcccttgataggaaccaaattcattgcatctttacccctggtccccaccagcttacctccccttgtatctccttgtccaagccaggggcttgctcttcagaaaacacaagcttatacctctgtcttttgtgggaaactggcattgcaggctatattccatgatcatgcatttcctcatctcttcttattccataggaaaatgaattaagccaaacaacttgcttttcctctgtgtcagcaaactatggtgacccatggctagtttcggtaaattaacttttattggacacagccacactaattcatttgtgcatgatctacaactgcttttgcactacaatgatgggtgaagtggttaggacagaggcaatccaaccttgccaagcctgaagtactctctggccctttacagagaaagattgccatcgttgctctagtctgtcccatcccttcagacacttgctaacttaacaactggttggataagatattttatatcaagatgttttggtgtgccctcctcctccaaatatacttacatttgcattttaaccagagccttcaaagaaaggtttgattgacttaggcatttcagtgagagtaatacaaaagtctatttctaactttttaaacttttcaaccagttctgtaacctcatatagggacgtttcagtggaattttggtaaaacatatttgatgttttcgtctttcaagacttcaaaatttcttttcccatttagccaaattcatcatatttgtcttacattactttttttttttttattgccattgccattcctgatgagccctcctcgtggttgactgggccacattcccaaggttcttgccaagagccagcttagaggcttggaaccttttatcctcttttcccctgggattgggtgtggagggcatagggcaggggagtgtggagagtggaaacagggcagagaagtggactctggaaatagtcttctctccttgcaaagaaaaattagaatcctctggggtggtcttggatactttttaggaaatttgactcactcaaggtctcaccctgtctggaaatacatagactgcccttttgcttaggttttcaaaatcccactgtcaagccatatctgaatgattcctctagcaaaggtatttaggttttatagccactatcttaaccccaatttctcatctgttttcaggacagttcagagtgagcaaataaacttccagagacaggccagtgctgcttctgtcggtttctagtttgataaggatgtcttttttagccatgctcatacttcccctgttgggttttctttttcccagcaagcacagtgtggccttgatcttcgacacatcaccgtggtggagctggtgggtgtgttcccgactctcattggcaggataggagcaaagattatgcctccagccctagcgctgcagctcaggtagggggaagttctgttcttaaatcttatcccctgtgaatgcatttttaactgattaggttccctggtttctttctattcaggattgagttcaggcaaccttcaatgtttaattgcttttattctgggagtgttataaccatactaatcagtatgttgctgtttgttcaaataaattgtgcagtgggtaattaccagtgttctttcttactccctccaaccaaccgtttttgcttcatgtgtgtgtatgtgtgtgtgtggttggtggaggaaggatggttaggagaggagcacctgaagaaaagacttaagcaatcatggtcttattagaagagcatgcatccaattagacttcccaggcttggtctcttttttctccatgcttccagaacacttgttcatacctttattttaacaattatattttagtttcataacccttacaaagttggagccatggattttagtctctgaataatgatgtattaaagaagcagaattcaacaaccaaaaggtaatttcagaataacccaaatttctacttgcatctcttgaccactgtgaaatcgataattaggctaaagcaaaactccttaaaatcttcctttctcacccagccttttctctcacacactgcatgggagagtacagatctctgttttcagggtcccaggctgctccctgtctctcagggcctcaggcagttacaaacatctcgaacacgtggctttcaggcttctgcaaaagtggggaaagagagtaaaaactcacactgactcctttatgcttcacgttggaggtgccacaccttgctcactctcttagttcattggccagaactagttacatgattgcaattcacttttaagggaggctgggaaatgcagtctttctgtattgccagaaagaagaaaatgaaatgggacttggtaaaccctatcacacctgttcagaaggcacagaaattccttgagaggttatatgatagaaacatatccttagcaaatgatgctatagatagacacaatagcttctttctctaatttccctgttttccagctgcctttgacccatcccatgtttgatttgtaccactttccacccaaaaagattctgccacattcctaccaaggtaaaaaaaaaaaaaaaaaaaaaaaaagaaagaaagaaagaaagaaaaaactcagagggccaggatggaagaaaaataagatgattcatgagttctctttagtcggctgatgaatggagaaggctgggtacactcatatgcttttgtttttgttatattttactgcatttgcatgtagcacctccccataccgacttcagtagcagagctttcaaatattggctactcagtacctagcacagtacctggcaccatgttggcgctaagtggagtaaatgactcaaaatttcattgaaacagccttactatttccagaggtgataatagcttttaaaagtatattgtatatctacagttagtatacaaatacttcaagttgaagtgtacaaaacttaagacagagagttgtgttgatatctaaatatttatggtgaatattttcaaagtaggttttatgaagctgttgcttatttagaactacttgctcatatcctgtgtcaatgattttttaaaacttgttgcagaattttctgaatggtctttggattgaatgtgtgtgtatgtgtgtgtgtatgtcatcttcataaaatcttgatgtgattttaaactgtttaatctacttgaagaacagaaaaatgtgattaaaaaatacttgtcattcagattgtatatattggggctaccatagacttctataggctgaagataatttttaaatacattatgtcgtggttctcaaatttttaacctccatcagaatcccctggagggcttgttaaaatacgtattgctggagtctacactgtaggctctaaactgtgtttctgattcagtaggtctctggtcgtacccgagaatttgcatttctcgtgagctcccaagagaccacatggtgaggaccactggcctagttttttaccaaagcctttacagtttgaaatagaatttttgcccagcagccttcaaggaaagggtcaatcactattttgcagctggatgatagtccaggtaaatgtcatacagaaatgatcactcaggtgcattacctaatggattctgtgtcaggccggcatgcctgtgttatcaaacatatcagtgagaaacaaagagcttggcagaactttttccctttgaattggaaaggtgttttttagacaccttggagtctagtgcagaggaaaaaagatgatttaggcaaagaatgggaagcaaaagaggagaaggaaaagcataatgcctgcataatgtaaaaattctcttgtctggctattttcaaatagcaccaaggccgtgataaaacccttgaagggagtcaacagaaagaagagactgggtgcctggggttgcagggtcaccgcctaccttctttcttaccctcatttcttttttatctggaggtatgatctgattcatgctttccagaggaattttccagcaatctcaaggaagacagggaccaagaaagccatagtttctatacccacattattctttgagtctacagtgttccctggaagactttccaggaagaactccttccaatctgacgacagacacatatgtaactcaggcatactgtcggcatcacacctcatccccgattttgtgtggtgtttgatcattcatccccaagatttctgtggtctttcggccctagtgggatgcattcctgtggctgctgctagcctgctgatccaaccactcagctcttcccatgacagttttccctctttacattctgtgtcaatgaaggcacaagacttacacaggaatgtgtatggtagcagatggtggcaccgtggtggtggtggtgggggttcccatcctagtctcacaagcactataaaaaaaatgaatgctccaatttcttattggtcaccctttcccacaggcttcagccaccacattccctattcctctgtttcctgagagctccctgtaccagaactcctccacgctcccaaaagaaaactcaatatccttccccttaaagatgcagagcattttatctcttcattcacacctttgcagcctacattcgcgtgttcagaactcattaatgcactttgcagtcatctacttctgagctcccctcttagcactgcaggaaacctggcagaggtattgtcatgtcctctttatttcatttctagtcactgggagtgaactggcaatttagctccccactgggataaaatacaaattattcccttcttcctcgaaactccctcttaaaaggcagaaaaaagtagtttgtgttctatgtaatgattttttaaccttgatctgtttgtatgaggaaaacatattttactttaaatccagatggcagtgtatattctgcctcatacataatctcaaaatatctaaactgaaaaaaaaatctggagaagagactgagtgggctcatttattcattgggctcagcttatctgtttgtttgctttctctagctattcccatctaaatatgtttgtgttgatataaaaatcatattttttagtttaaattctagtgtggtagagcagaaagaacaccagacacttgaaaccacttcatattcttttttggaattatttggggtacaaattatgattaatcaagtcagaatacatgggctgtagaccaagctcaatcccttataactctgcagtcctgagctggccactgaacaggccagaactatcatgctgggaaattatatcaatcagctttacctagcccagagtttctcagccttggcactattgctatgtgggaacagataattctttgtttggtggggacagttggctgtgcattgcaagatgtttagcagcattcctggcctctacccactaaatgccggtcacatcttcactctccactgtgacaaccaaaaatatctccagacatggccaaatttcccctgggggtggggagcaaaatcacccctgttcataatcactgactttgtcctagtgtgtatgtggtcgtgcaacactagtcagcaaacgtgggttttgggttgattccaaacttggattgattccaatttaataaaaaaaatctgttagccttgtatgcaccttgtaccaaacgttggtatgtggcaccattgtacgcctgaagtcttcctgactataatctaaaaccaaagcagtgcttttcaacctctcaggtacataccagtcatctggggatcttgatagtaatgcagacactaattcagtaggtttggggttgggcatgagagtctccatttctagcaagttctcatgtgatgctgctggttcaagggtcacagttggagtagacagggtctaaaggatgattcagtccttcattgtatcaaagctttctctgcacactgtcacagtaaggctctggttgatccaccaggacccttgggagtcatggtttgacttagtctcctcttttctttgtctgccacaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggagcaaatt

SEQ ID NO: 3311 - DNA, 71560 bp, human
cccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggtaggatcggaggcgtggctgcctcctcagctgggcaccaaagacccccggagtcgccgttgggacccttcgctcgggatagagggaggtgccgggggcgccctttgtttgcgcagaactcctctttcgcagcccgagggtggggatgatgcggatcggggctggtgtctgggcacgcgccgggaagaactgaccatcccatctccaggcgcggggcgccctcgcggcgacgggagccctagcaccttctgcgtccgggcttccagagttccaatcaaacccttttcggtgtaggaggctccacagagaaagtttggccgcagactagtttgctactttctcacccccagaattttgcctctcacatggttgcccactggaggctggcagcttgtcctggaaggagcctctatgccctcccactacacgtcccaggctacccccttggggccgcaggacacgagccacggtaaagcgacttttgtggaaggcacgggcggggcctcccctgaatctcttaaccccccctgctggggattccgagaaagtctgcgcctctgaggaagaattgccagctgagagtggtgacatgtggcatgcacttgattagccccagggaaagagggctactcgcgcaaggatctgctgggcagagggtgcggcttattcctggagggcgtggtctccggcatctaagggggccctggtgtttcttgggggctctcatggtgtgagcaaaattctctttggagatgcactttaaaaagctccagctaacttcctcaccctggagtcttaggttagcgaagagcttcaggggagtagggcaatgtgccatgcactcctgttgcctcggaatggagaggaaatccatggatgcgttttaatttagtgttaatgggaaagtgggtgacgtcggctatagggcgtgcaaatatttggctctgcgttcaacaccgtgggcagcttaaatctagggtatgagaaatgaacctactgagttctggtagaaggatagaggatgcccatctttctagcagtgtgcttgggagatgtagggatggctgcgggaaattctctgcacgcacctaaataaatgaatgaatagaacaaatttgtaaattaataaacaggaacatttgtgttttgagctgactcttaagttttaagctgctttgtaggaactgattcagggtaaagtggaaaggaaattttatccttactgccaggcaactgttattcccatggtgtgttaatacctcctctcccaccccctttagcaggaatcaggttaaaatgaacctgtaggggaagaggaagtcattaagcgtcccagaagcagctttctgggagcgggcaaataaggtgagaagctagaggtagcttttccgcactgagttgggaggtgcctgtgagctgcctgggaacctcaacttttagttgagcctttctcaagctggggaccccttctccttttccatccgacctccctccgttctcctcccctgccctcccctctcctttctctcatcttccacctttatatagtacagcttgctaccagggcccagccacagaatcatgagttcgccagtttgggcattcactaccacctgtcttttgggacctatccctggctttcctggctccctctgccagcctgcaagctgctcccaacttttagccaccatgttcctgcttgccaccacctccactgactcctaacctgccctccggctctgctcagaccacaaatgagctgaagctgattggagctgcttgataaacactcctcttgagcctccttttggcatggctcaatggggtctcttgggaagtgtgctccgctgaggttgtgagatccagaggaggggatttcagtccaagccagaggctttggaaggctggggaggggaaaatctctaggcccttgggtctgaaagcaaatcacataggctgagttcactctaagtgctgggtgacaaattttaaagatcatttcagagacactctcttagcaagtggacatcatatcttcagtaagagagaaagtgaaggacttgaatctggaacttctgaaagaagatggagatctagggctccatcagcaagtcgattatgtaactatctgcacgtgaatagcacatctgtcagagtgagagtaaatcattctcattcccactcctagaaggtctctggagttcttccatcttagaatttaatgcagcttttctggctctctgatctattttttgcagcctagcaaagatgcagtgtctataaaaacctacatgaagtgtatggaaaatttgtagaaaagttgtttgtgtttgactgtgtttgtatgcttataacagatgagaatttagattctgttcttaaaataattcttagagctgtatttgcatgtgagatagtggtggttcactctgcctccttctgcaaacaaggctgaagatggagaatgagtaccatggcctctaagaaaggcttcgtgaatcttacatctggagaaaactggtaaagtagcgtggttttactagtcaggaaaaccaagtgaggtttgctaaaagccaaaccagactacatcagctgaagcagtcttttgaaataccacatttggagataagtactaggaatggagcacctagctcaggttatataattaaggtgtcaccgggaacaggctaggaattcctatttagatttaaaacatgtaatcagctgacaaaagtactctgcaatgaaaaggaaatatgctggggagagcaggtcattttcctctggcattttcttcattgataacactttcagtacagtacaatgttgtttgttagttactactcatttcgcagatttgggagctgaatgagacaccagaaaccattgttaaagcagcgtcttcacatcttcccacctcatcagtcctcgtaccataaccaaagtgctgcttttctcttttagattattgctataacattctcacttttggtctctctaattctagctcattttactttctcactttagataatggtcttttaagtccattgactttagtactgttttttatcacatcactcccttactcaaaaacttagggcagcaggtccctgttctcactcaagtaaaaagttctcagttgtttttagggggctacacagtttgcttctagcctaattttccagtcttttccccctggtttcctaaaatcctatccttatagaacctgagtcacattttccttcttggcagatgctgctttctgtacctggaatccttcccccttgccatttgtccaaattctgcccatcatccagcaacacccccactttgatgagaccttttcttgatcgctccaatgggaagcaacgtgccttccttttaacacccatggtctcactcatgtctcttatatttatcacatatatcacatatttgataatgctgtatattatcataatttatgcactcttcttcttgtagattttaagaccttggaggcaggggccgtgctatgtcttacccttatttgtatttcccacggtgcctagcagagcactttgtgccacatggatatttgtgcgtaatggattaacagtgcctgtaactccagtgatgggccattggacaggaaaggagctgagggaaacatgtgcacaggtacacagggctttgtgccaccatgaatctacatacatagaaacgatggcttactggatacagaggttccttttaaatatacgaacactctctgtttaagcaataaccttctctgttgggggctgtaagatgagagactgactgcaaccgcaagctggagtttgcatttattatttttgttggccaccttgatctgtgcctttcccaagtggttgaatggtttccttagtaaacgcaaatatgtgtgctacgtcaattcccctttcagagaacacaactgaaattagtaattgaaagtgaagagagaatttgaacagaagaaggtttagttttgccaggctataacatagtatgaaatttgtagcaggcaagttatgattaatgcccaggttagagattcgcttccaaaatagcagcgtgaataataacctctcccaacttccaattcatagggagtttctcaaaccagcccctcagttcttgactgtgtgatgtcttaactgctaacttttatgggccatttgttttaggagggtggtcttttaagcctgaatctctgggaaatttgggtttagttctgaaatagaatcagtttctaccttttctaataaatcctgggctctgcccagagacttatttttaaagtgaacactgaatgatgaagcatttatgtgcttgggagaccacgatgaagaaggtatgcaatttcttctctctcgtagctttctgtcttgtggggaaatagagacatagttatttcaggtggtcaatgttataatacaattggattgacaggcccggggagcacagagaggagctatgtgggaacactggaattggttattgaagaatgatgctgagacttgctggtgcggagatggtggcactaaaggcccaagaaaagtgaaagtagaggatgtgtgggcttctctaagaatgttttgaaattggagacaaaaatctgtgtgagtgtcctttttctggggagacggctctatcccgattcaaaaccactagttactagagcaccttcatgaattctatgagaaaatatgcacttaatgggcagaaaaatcaacatacagagtaagatgaaattaccacagtaggtaaactttgattgaaccagtgagcaggtggcctttccagttacagccagctgtatagtttccagttattttcatttaaaaagcagtaccaagcaaaacagatgtaatcgtaaattgtaattgccttcaggcctgggctggtaacttgctgtacccccctgccccacttagtacacagtgtgacttgggggaggatctttagtcagtatttgtggattaattgattgaagtaattgtgaatcaaagtattccatttcaaatctcccctgtaggatttaaccagaatttccaagatgacactttcctgagaaaacggattgcaagatagctaaatgtcaaaggaaatttgtccatttggacaggcaacgaatcagggcatagttaattgcgaaggctcttggatgtcaaatcaccgtaagacattctaagagacttagaaactcaagggagttctgggggcaggatgtgcagataaagatttagaggaaaagcttgtgcaagagaaaagtccttggtagcactgctaagctcccaagttttccagatgataattggtagcacctggatcttacgggtgtctggcacattctgacctcagaaacctctggagtactcattcccgagctgaatgattcactcacccgtaatccttagctcacaatggatgcttctttatgcattgttctccagggagaagataaatgggtttggacataatggcttggattatcccagaggtttggggttgtaaattgagcataatgattttcaaactttcttctgagtaatagatccaaacatagaatctggggacagactttctgccttggccttgaaatatcattgcaatatttcttctgtcccactcttacagtgacctgtagtgtagtcacatgtactagcagctcatttcccctgctatcactagctgtttgcaatgtacatccagtagtacttaatgagaatctcctcaatgctgattacaccccatgatctgctaatggatgacgctcgcctgccgcttattgtgtgggtggctgagctgaatgaccctgccaatcccagtgatccaagattgttcgcaaacacggttaaattagggccacagggtgagaattaagccaaggtttggcaggcccattgtggagtggtgaggaagcggtggagcggctacatcctccacctcctgagattctgcccacaaagtggcaattccttataggaactctgacagacatgttggtactgactcagtgttagtcagatcaaggctccaattcctttcaatccccaacactgaaattttgtttccacttagattttaattcagctttccaaggagtagggtcattgtgttgcaccattacctattcacggagctgatgcccccagccacgtgagtaggttgtgggatcttgttcatttttgtattctcatggtctagcagggagcctgacttctgggaggctctcagtggatctgtggagtgacatgtgctggggggcatgcctctggccagttctgagcctctgggtgggtgtcttggtctttatctagatttctgcaggagtttctctgttccacacccaggctcccttgcatgggttgcctaattcatggaaccacggaacctcagactgggaggatgcctgagatggtaacttgccctgcattttagggaggagcctctgaggcttagcaagttgaagggatttgtctggggtcacacagagagttaaatgcagagttgggagtagacctcagtctagtggctatagaattcctttcacttcataggcatgcattgaattcaatttttgagtgatccctacatgtcaggcatcctgtggggaaccagagataggcaggcaagaatgaatggcactgagcatttgatatggtttggatctgtgtccccacccaaatctcatgttgaaatgtaatcttcagtgctggaggtgggcctggctggaggtgattggatcatggggggcggatttctcatgaatggtttagcaccatcccctttggtgttatttttgcaatagtaagttaccataatacctggttgttttcaaagtgtgtagcacctccttcctctctctcgctcctgctctggccatgtaagacatgcctgcttctccttcgccttctgccttgattgcaagtttcctgaggcctcctcagaggtagaagctactatacttcctgtacaacctgcagaaccgtgatccagttaaacctcttttctttataaattacccagtctcaagtatttcttcatagcagtgcaaaaatggacgaatacagcattgttcactgagcccctgtccagggtgtatctcagggctattctttatattgacacttggctgtactctcagcatctcatatctagagctgtttggatgtttttcaagagttctgagaagttgctgcctcagtgtcagtccttgccctcttttgaggttgtcagagtcccaaatgcttcctctctataccatttgctttgagctccccaactgatttgtgattaaattcataacagttttattgagatacaattcatgtaccatacctcattcatttaaactgtacaattcaatggtcttagaatattcacagagttgtgcattcatcaccacaaccaattttagaatgttttcattgccccccaaataaactccaaaccttagccatcatttcttaatcccccatccctaggcaaccactaatctattttctgcctctatagatttgcctacaattgaccttccataaaaatggaattacacagtatttatcattttgtgtttggcttctttcacttagtatagtgctttcaaggttcaactgtggcaggatactagccagagtcagccaatggtgcctggccacctctcaatgctggctgcagggccaccactggtgcataaagcacctttgggtgaattagaaaaagaggcccccatctggccacatgtagatctgtggacacagggcttggtcaggagacagactttgggcaagaaaaggatagaggcaggcccaagactcaaggacttgaggccttgagtccaaggattcaagacttggagagtggaggacaggcttgatttgagaccccacttgctctttttgagggtgtgacggtgggtgctgtagtgcagggaactccctgaactatatctatgtagtcctggatgtcagtagcttaactccaagtggacaagctatggaccccatattcttttagagcttgtgactctgtaaaataacaaaacagaaagctgtgcttgcatgccagcagcatctgtggtgaactcttgggtcacctgggagcacgttaaaattgcagaagctcaggcccaaacccaagacctactgaatcagcatcttcattttaacaagatccttccaatgattcttctacatgatgaaatttaggaagtactggtctgatgaatgagttcagcccttggccaagacagagtggcttgcctgtttataactgacacacaatggttcacttcccctcctctcccttttcctgttggctttgccttcatcactgaatcctctgaccttcctttcctaagtccccagcattcctgagataagcatgtacagcctgtaggttaggtttttcctcccttctctaactcaaaaacaaatgcaacctcccttggcttcatctccttttaagcctttctgccaggaatacagcccctgcctggcttagccttgagcagcagcaaagcacatcttcaggctgattggtaacaggggccttgcatggctttttcctgcagctaagatgtattaatacctgatgaataactttagctgtcaagaaaaccaggctagtgtgatcagggccgctcctgccactccggcaagactcctggggctgagaattcctggaactgatcagctcttaaagacacagggacttcttatcttcataccagaaatcaatgacactggggttagcggggaggcagcaccttgggagatgagtgagagtgagaccagtgggttagtcaggaaaacacacagcccctcacattaagcccctcaagctccatgaattggggatgtcaggaagactgaactgttaacagcacttaaagagggtctctcaccttttcagggagttgggtaagtagtagtttccaacccagcaatggtattttttttctctgttcttttcctcttttttttttgaccgagtcttgctctgtcacccaggctggaatgcagtgacatgatctcggctcactgcaacctccacctccaaggttcaagagattctcctgcctcagcctcccgagtagctgggattacaggcgcgtaccaccacacctatctaatttttgtgtttttagtatagatggggtttcaccatgttggccaggctggtctcaaactcctgacctcatgatctgccctcctcggcctcccaaagtgttgggattacaggcgtgagccaccgtgtctggccagcaatggtatttgtacaggctgagtaaggatcacctggggagtctgatgaaatatggtttccctggctccgcctctgtgtattttgatttggtagatctaggttagggaccagtaatctagggtgaaggtctgcaaacaaagtccaggcaggccaaagatggctcactgccagtttttatatgattagttgagctaagaatggttttaacattttaaactgattgaaaaaaaatcaaaagaataataatgttttgtgacaaatgaaaatgatataaaattcaaattttgatgttattggaacacagccatgttcattcctttgggtatttgtctatggctacttggtgatacgatggcagttgaatagttgtgacagagtccatatggcctgcaaagctgaaatattttcctttacagaaaatgtttgccgaacccctaatccaaggccttactcaaagtgtggtttgataaccagcctcacctgggagctttatagaaatgtagaatcttgaacaccatcacagatatgaaataagcacctaccttttaacaagattcctgggtgtttggggctacttcttccccaccacgaggctcagctcaggactcatcttggaggtccaggccagcatgctataactagccttgtatacggttaatttatctgacacataactgggtgtctcattctcaaggtttgaggcttggtagcctcctgatatcttagatgctctaaaaactaggttgctgttttattcttgccaattcttggctaggatccagtgtcctaatctgaggctggaggtggactggcttttgctacctgctgacatatttcttaatgcttcctggatttctagacagcagtctccagatgtgctgccctgccaggatcttggtatgtagtatggcccatagctctccaccgtctcctacttccttccatgaagcactgcttcccagagacattcagaaatggtatatgggaagcaggatgcactgtaatttagttgcaaaaggctgggttaaataggtttctttattgcaggactgctcagggtcattgatatgccagtataccttgttactctctgagagaggacaaggaggaatagtgaggaccacagaatctcaaagtggggtctgtagaccagcagcaacagcagcagcatctcctgggaacctagtagatatatacattctcagaccacaccccagagctactgaatcacaagctgggtatgtgggaagtgggcctagccatctgtattttagcagatcctccaaatgattcttatgtacactcaagtgtgagaaccactggtgtggacgtttccaaatggttttctccgaacatctcactagcctagtgtttcacatttgttgatttcagtgaacactgtgtttttggtttcaggacaggacatttgggaacatgacattgaatttttcctgaagcatttactggtggcagtgaccactgcaggcttggggaggtggaagtggggaagaaaaaaaaccccaacctttgggtagcatcatctgtcccacatctgtctctctagcaattgtgtcttggttaaaggaagtttttttgagacgaaagccaccaacttttgggtgttgccaacatgtgttctttaaaatgtgtttttgtgtattcaaatgtaaagaaagctggggaacagcccttggggtgtttctctctcctcttcacgttacttcctttcagaatactttcttctgtaaaatttcctcatccaaattccaaactcatcttttcaggccagccaagtccaaatggctttcatttgagtgagtgacccttttctccatgggaagcctcaggacacattcagataggagggaagctatggctctcagcatgaggaggctgtgtcttccttctcaaagctcagctcactccctcccattccagaccttcttcctttgccttccatggctagtggtgtcacagccatgggtctgtgtgtgaacactttttagtgtttactctgtgaggatatgtaactgctgtgttgtcacttagtttgaaattctcagtgatagtgaggcttgagggtgagttgggaggaagcactaagttattctacttcctccatgggctggccgctgaggagaggaatgagggttgagaaagccatgcagaccttgattttcagtgaaaatagatgagacaactgacaacttccatttctatgtttttggtgggcagaaaatagatattatcgtttacttttcttggcttggtggtctgaatgctacacatatctataaaatggcccatctgatattgcagatgagctgaaagtatcctctgatgaatgtactttaacaaggctttcaaaaattgtaggctgaccactttttttccaaaattttttgcaaaaaaaaaatatatatatatataggctgagcacagtggctcacacctgtaatcccagcactttgagaggcctaggcgagagaatctcttgagcccaggagtttgagaccagcctgggcaacatcttgggaccctatctctaaaaaaaaaaaaaaaaaaaaagaaattagtcaggtgtgctggcactcacctgtagtcccggctactcaggggctgaggtgggaggatcgcttgaacccaggtggtcaaggctgcagtgagccatgatcatgcactgcactgcagactgggtgatagagtgagtccctttctttaaaataaaattataaaagtaaaacatgctcattatgaaaatattcaaatagaggcataaaaagttgaaagcaggcccacccttcattttcctcttgattccattctctttttctgaaattgccactcagtagtttgatataaacttctggacacttttctgtgcttacgattcttaaacaaaaaaggtaaaaaaggaatgtattgctacatgtaacaacagggatgaatctcatacataatgttcagtgaaataaaccagacacaaaagagtacatatggcaattccatttctacaaagttcaacaacaatgtgcaaaactagtccatggtgttacaagtcagaatagcagttgtctttatggggtagccactgggaggggccacaagggggtcttcaagggtgccagcagtattctgtatcttgatctgggttgggaggtctcatgggtatgcacatacatagaatgtattgagctgtatacacttaagatttgtgcactttactatatatgtttacctcaattataaagaaaaaaatacccacaaatgtatgtgtgggcggggcataaatggatttaagatgtctttgttaaatttccatgccattgcctatgggaactttggaaatatatggtagtgatttgggttgtcataatgatagagaaggccaggcctacacaataaagaattggctcccttagaatgcccatagcgcccacattgaaaaacactgttttaaaagtttgcagactgttctattgggcaggtgttcagaacatggggtaggcctttgaaatagtcttgcctggatctttactctgtctttgtttaaatggagttgaagcctcaagagctgatgtggatggatgggttcttgatttgtttttgccttctgaaccaaattgtaaaggagtggaatcatctcctttgccagggaacagaggcaatttgataaccctcaaatgtgaacttgatgcaagagagagctcttctccagctcagtgtatccctcccatgctcatagctctctgaggccatgtggcctccgccagtgtcttggtctggagtcttctgctgaaagtcttactgcatcctcctttcctttcttagattttctctgtgtcccatttgacctctatagaggagagttaagcatttgaaggaccacatgccacatcacaaattgcttttgttccactgtctggttttactttaaaggctagccctctttttgtctgtctgtgttgactggggacagtcaggctacagagctttgtgaatgccccttggtgagaacaggacttggcatttattgaggtcccctgctttgggctgacctcctcagatttaggtgtttgtcttttttctgtttctcctctctcccatctctgggcaatgggcagggacacactttggcccttcgtagtattaaacaatagaaggagactaaattggaaaaatattattttccccttggaccagagtaatgccttcatttataaagcttttcttttaagtttatttttgttggctctgtaaagtaggaccacaattgatatttcacaagccacatgctgttttaattgtctttgctaatgaaagacagagggcctggggattatgggtgccatggactctgcctagggtcttccttttggggtctgcatagaagagtttgaataagaggatggaatattgtctaatattgcctctgatgaaacagctgtggaagcaaggctgtctctgagagctcatgtctggcagggatcattctctcaccagccagccattctactgccatttatttctggatgaaataaagttaaaatgaacatttaagtgtagcctcaatggggaaagaagttatgtaacggtagtatttggatgccagagagggaggaagagtccccagcaggatggagccccaattgcccacaacagtgactcacagcagttgcccagtgagcagtacccttattgtctttcttctcttcgctgtctctctgctctagtccatcgctatgcttcctgggattgcttcccaaatgaactacttgtactttgtcttagagtgtgcttttgggggaactcagacaatggctaagctggaacttaacccaggattttggtttctggtccagagttctttgtactgctgaattgactcctgctgaatagaactctctaggtcactgaatgaactgtaaagaaggcttctgtgatggacacttggaggttgtttcacttatcttttgatgcataagaaaccactccaaaacttagtggtttaaataagtgacaactatgtatttactcatgatcccgcagtttgggcaggactttgggggacggctcatctctggttcacatggtgttgtctggggtgactcatctgggtctagaggatccgggatggttccactcatgtgtctgtgtctgacacttcatctgggatgactgaaatcgctgggatggctggtccctctctctgcctctctgcagtctgcatagtttagctcttttccatctccccgtgttgccttactctccagcaggaagctggcattacatgcagctggcctcccagtggacaaaagccaaagctaccaggacacttaaggcatagatccagaattgtcacagcatcacttctgttacattctattagtcaaagaaaatcacaaggcaggcccatatttgggatggtggtggtagtggatggagtctacctcttatatgcatgtgcagggtgggaggaattgtcggtggccactgtgcaggcaatccactacagagctggtttgggacggcatattggagatgggagtttaattttccaggatgtttgctgggtgccttctgattagatgctggacctcaggttgctagccaagtgtattaggctgtttagctacagaatgtggcatatgcagattcattgaaagttcatagaagtgagtaaatcagcatccctgggaatatcaaaggctcattttccaatggttattgatactatcaaagacaaagactttattaaacaaaaatgaactcaaaatagatcatagacctaaatataaagcctataaatatgaaacttcttgatgacaacatgggagaaaatctttgtgaacttgagttaggcagagatttcttgaatatgacaccaaaagcatggtctataaaaggtataattgataaattttactttattcaaattaaaaacttctcttccaaagaccccactaagagagtaaaaagaaatatataaagaactctctaaactcaataacaagaaaaaaagccacctaatttttaaagcagacaaaatatttgaacagatacttaaaccaaagatgttcaatattattatccacctgctaactggattaaactcaggcaacttctgctttcgtctgccaactgtgaacaaagccacctgctcttttagggaagtgatttgtaatatacagtgcaaatgtaaggtatggttatacctcccacaaaacaacttgcacacatttctgctccttgtagagggctgactagccattttctctgtctctctcactggactttatgtgacagacacccgcaaattgctagccatggccgttaagtaaccactggccactggcaatttgaggcagatcatttactgtaagctcaagtggacgtgggtgtctcctaccatgcttttccaaaccaggctggtttttaggcctccctaaaaaaatctcccactgcctacttgttctgccctcaagtgtcctgatgtcctttcatttcaaggaacttgcatcatttgagcctgtaacagagggcttttagtcttctttggtactattgatatgtaagaaatgtactttgactttgatgtttttctttgaattcatttgtaagcaatggtaaagtttgaaatgtattacttcatattatcatatattattcttctcaagacctaatgttaaattcaatgctgagtgcttaataaggatactgattacatgagaagtaacagaacagttttcatctagtttctaaatttaggggaaaaaaaagcttggatgaacgccaaataatttcccacttttgtgaatcccaaaggcccctcttcatgcattgaacattcctgaaatttctggaataaaaaaaattgtgagaagaacacacagggtttttaaaaacgactttttacttgaggtgtacttgccatgtaataaactgtactgaattgctttcataccattttcaaaaattaattggaaatttttgtacagatctgtttctgggttctttattctgatccattggtttatgtgcttatttcttcactaataccaatactgtcttgattactgtagttttgtaatatgtcttaaaattgggtagtgtgattcctctaactttattcttctttccaaaattgttttggctataaatttcatataaattttaggatcagtttgtttatatctgcaaaaccttgctagtattctgatggcaattatgtcacacctactgatcagtttgggggagaattgatatccttaatatttgaatctttcaatccatgaatatggtacatctctccatttatttagatattagttgatttctttcacaaacattttttagttttcagtatacagatcccatacatgttttgttagatttataagtatttcattttatggggctactggaaatgtttttattttcttaactttcctctctaatagtttattgcaagtatatagaaatacaattgatttttgtggtttgactttgtatcttgtgatattgctaacctcaagtgttattttgtcgattctttgagattttctacatagacaatcatgtcatctgtgaatagggacaggtttttcctttcttccttcctgccttccttcctttctttctttcttctctccttttgttgcgcaggctggaatgcagtggcacaatctcggcacactgcaacctccacctcccaggttcaagtgattcttccacctcagcctcctgagtagctggaactacaggtgtgcaccaccatgcctggctaatttctgtatttttagtagagatgtggtttcaccacattggccaggctggtcttgaactcctcacctcaggtgatccactcgcctcagcctcccaaagtgctgggattacaggcgtgagctaccgggcctggccagagacaggtttatttcttcctttccaatctttgtatcttttctttctttcttgtcttattgcactggctaggattacctgtatagtgctgaatagggtagtgaaattgagtgttgtgttgttcccagtcttagggggaaagcacctcagtctttcatcgtaaagtataatgttaattgtgggctttctgtagatccccttcatcaggttgaagacattctcttctcttcctagattgctgtaatttttttttttaaatcacgaatggatgttaaatttcgttaaattccttttctgtattaattgatatgatcatctggattttcttctttagtttgttaatgtcatgggttgcattgattaattgatttttgaatattaagctaggcttccactgtcaggatacgtaccatttggtgttaccatattattctttttatgtagtgttgtgttttatttggtaatactttgttggggatttttgcatctgtgttcatgactgatattgtcctgtagttttattttgatgtgaagtccttatctggttttggcatcagagtaatgctagccttgtaaaatgagttgggacatgtgttctccacttcaattttgtggaagacattctgtagaattcttttaaaaatatttgatagaattcaccagtgaaatcactgtgcctggagatttatttttaggaagattatctattcatcttgagtgagttttgatagttcgtgctttttgaagaattggttcatttcatctaagctgtcaaagttatgtgtagagttatacacagtatctgctgtgataccctctgtttcattcctaatattggtaatttgtttcttttctttgtttttctttgtcagtcttgcttgagttttgtcaatgatatgaatattttcaaaaaacagcttttggtttgattgtttccattgtgttgtttcattaatttctacttttgcctttattatttttattatgtcctgctgcatgctttgggtttgttttgttctgtagtttcttaaagtggaagcttaaggtattgttttgaggccttttcctttttctaatataaacatctgatgctgtaaattcccctctgagaactgttttatcccactcactgtactctctctcctctcctttttgaactctattgactgaaatgttaaacatatggatattgtcccacagctccctgaaaaaaccaagattaaaaagaagattgaaaaaaaaagtttattgagcaaggggaagaccaagaaagacaaaaagtcacaaggagtcttcctaccctcttaagaccacatcttctctacagagaaaaaaatctccattcccagagttttaggtatctagagtttgctatacaattgctgtagtcgccactgctgtcactcctgcccactgtcaccacagggttatatgggggctgggtcatgaaataatggagaaaatgaacataaaagaaaaccagggaattttcttcattctctctgaagcattacagttcttcttttccactcttagagtcagagatagagggcttctcctggaactctctctgtacccagtgtctacttctgtgtttgggctgattttagtctagtcctgggataccagagcaacaccaattcagtgttaccccaaattcttttttttttttttttttgagacggagtctcgctctgtcacccaggctggagtgcagtggcgtgatctcagctcactgcaagctccgcctcctgggttcacaccattctcctgcctcagcctcccgagtagctgggactataggcacccaccaccgcacctcgctaattttttgtatttttagtagagacggggtttcaccgtggtctcgatctcctgacctcgtgatctgcccacctcggcctcccaaagtgttgggattacaggcgtgagccaccatgcccggccccaaattcttagtctgcctgctaatgtttactttttcagaatcaccaaagagctgttcagatgcactttgttcaggtttttcagctgcattcagtaggaaagacagggtgaagtacgattactgcatcttacccagaattggaatattgtgacctttttttttttaacattacattatccttttcatggtagtcaggtggttttcttcctcccttccttctttctttctccctttgtttcttcttttctttattttctactttttcttcactatgatgcctagtatattgttagacctggataaataacttttgactgttgcagatggtgaaaagtcttttgtgtgaggttttatagttattacaatttagagaaaggattggattgtttatcattggaaaacactttgttttctaaagatatatctactaggatgagagaagaaaaaatcacgatctaaaaagtggggagtaatagtcttatagagtcactgtgaaagttcagaggaatgatatatttgtaccaggaacaaatatgttacatttgttcctttaagtaaattcagtcccatccaaaaacgtatttattgacattagctcatttttgaaagcctttttaaaatgagctaatatcaataaatatgttaataatgaaaggaacctaacaatgcagaatgattaggcatcaaatgctgtatgtttactgtggtttgaatgtttgtcccctccaaaagtcatgttgagatttaattgctgtagtaacagtattaacaggggacctttaagaggtgattgggccattagggctctgccttcatgaatagattaatgccattatagcaggagtgggttgttagttatctcaagaatgggttcctgataaaagggaggagtttgcctcctctttccctttctgtctcatgtactcccttctgcccttctttcatgagatgatgccgcattaaggcctcaccagataccagtgccctgttctggggctcctcagcctccagaactgtgagctgaatagacttctcctccttattaattacctggtctgtggtattttaacaacagacaatggactaagacagtgtccttcttctgctttattagatagcttatttcaaaagtgaacaagcaatcctgcttgtagtctgagaaatggaaattgtggagttgagggagattcagtaaaagatgatctttcagatgaggctattgttaaacttttcattaaattgcttttattttggccctagtattggtatcatcaaacattaaacagtcttaaaaagtgaaatgatacccagtcatctataaaagagtgaattgtgagaaattatatggcttatttcccagtagagacaagtgatttcacattctgcagcagacccatgagccacacaagtcacatgaaaggtggccatagctcaggtgtttggctcagctttctattctatccaagctatttctaatcacagatgaaccagccacacattcttattttgagcagacatctgaaattgacttcagcttaattgcaataacactgaggattggaaaacatttgtgttaacatctacattctgttcaaaacatcaacaaaagccaaatcccccaaattaataggctcttttgaagacttctcttttgaataaacagtgttgacatgtaattcatcattaactcataaaaacacttcagtaatataaatcaggattgaagtctaaaagccattctgctttcaattagagcatccaaatctggtatacgagaccttttctcctttttttttttttccagccactctgttattttgtcaatctaatctcatctgtatcctgctcacgctctaggaatcaagtctttccctcagatgcaatgcctgcattctaattttaaaagtagttaatagaatataccaattccatgtttaaacaggaagaaactaaggctcctgagaggtgatggggctagccaaagtcacatggctagctagtagcagagctagatgaggattcttagcacctcactccattattttaccctagtcttctagaaagaccctgtgctgttcccagagtctcacctctgaaatatcacactttttttattttttttaattattattattatttttttgagatggagtctcgctctgtcgcccaggctggagtgcagtggcgcgatctcggctcactgcaagctccgcctcccgggttcacgccattctcctgcctcagcctcccgagtagctggaactacaggcgcccgccaccacgcctggctaattttttgtatttttagtagagacggggtttcaccgtgttagccaggatggtctcgatctcctgacctcgtgatccacccgcctcggcctcccaaagtgctgggattacaggcgtgagctactgcgcccagcccacactaaagttttaaattcagtcacaaatgtttttcaataccttataagtatatgaaccaaaaccaacttgtgatgacattaggttggtgcaaaagtaattgcggtttttgccaatggcaatgaaaaaaaacctcaattacttttgcaccagcctgtagacgtcaggatagtggcaggtttctgaccatgttctgtttcttgatctgagttctcttacatgggtgtgttcagtttataacagttcattgaattgtgcactttttaaaaaataaaatatttattacgagtggcttatggtattatccctgattgttgctcgggccccagaacttaatatgttagtaatgtcctttattatgcaacgagtcacctttctcatccagcttaaaaaataattttcctcttaacatttttttattttgctctccagtatacttttgcttcccagcgcctgcctaatgtttgtaccatcagtgttgtagaatcctacttcaaaagaagcatttgctacagcccagaatcatagcggtaatcatgcagtgatcttagcccccaccccagggtgcttgcttgtttgatagtcactgtgagtgttcctaataagccagggcatatctggattcatcatttatcattttctgtgctccaaggctccaacaatatgtgtgataaatagcctgtagcttattttctaaatgacagcagtgaaacctcctgtttttctttctttgaattgaatctgagacacatgaaattggtattctctgaggcttctctcttctccctccccacatttcttttacagcaggggaaaaggcagaaacctaagtttgtgattggtagtggattgaaagccgtagatccttttctcctctccagagctaaggaaatgatcttttgtgagcattcatcactctgcctttttattatttctctctcttacctttagagtcttatttcgtcctgtcctccacctttctgtacaccactccctccccaaaggttgctttttcatagcgtaaaagttgatcctgagtatgtgtgcaagacattatttggtactacaatttcacagaatcatataatcttaaccttggaaagggctgtagagccccaccctacttccctcatctcacccctcttgccagcatccttcggcctcatgggaacacttccagcttcagtaagctttgatggaatctcaagatggtcttggagtcttagaataccctgcctcacactgggctaaaatcagctctacatgacatctagccattgtccttatttctcacttttggtactgcacaaagtaagtttctctctatttttatccatgggatgaccattgagaaatcagaacacagggattctatttccttttagtcccattttcttcaggctacaaatctaaagtttattcaccattcaacaaactttttatttatttgtttacttatttatttgctatgaaagctagtctctgttggtcattttttgttttttctttctagcatcttctggcatgtctgtgtccttctcaaagtgtggccccaagtgataaatatttgaggtgatagatatgtaaattaccccaatttaatcattatgcattgtatgcatatatcaaaatatcactctgtattccataaatatgtacaattataacatgtccaaaaaaaagaaaggaaaaaaaaagaattggcccaaatggtctgttattccagtgtggttgcttcagtctaggataagccagacttctttggtttagcctctgtcctcttgcaggccactgttgctctctcttttttaagaaactatttcacctgctggctcacaatgtgggcaactagctggctgctctttcccaagcctgccagggaagctctcccccttgctgggtgtacagcttagtgtagggagagaaatacaagacttcatgtttataatctctatttaatttctccttgtaggtttcaaactagctatggcctatggtttcatcatctgttggttttgcccatctgtagccaacattgttgatgccctgtgccatctcccctccgcccatctctggattcatctgcagctgaggtagacagttctcaaacatgctgacagtttctcaccttagatgtccacatgtcttagaggctttgcctttagatttactccagtcctgtgggagctcgctcagcaagaatttctggaagagtaggagatgtaacaccccgccagctcttagccaaaaaaaaggcaggagtctgtgggtaaatacccaacctttcgtgtccctgggttgtgtttcctcagaggctcctcagtgggaatgaatccaggttgcccccagaagtaacctgctcattagcatatctttatgggcttttcccctattcctttctcatttcccctgctttctcactgtgcttcctgggatcaccttccaaatgaacaacagcacccaagtccttgtttcagactctgctttgggagaaagaaaactaagagcttgtcctccccagcttggttatcttctacagatttgttcttcttaattcttccttcactggtagaatgacacagagccctatagcatatctcctgagaggaggttacctgttaatgggttgtgaaattcttgtagtggtcatgattagcactttttaaacactcaaatgtaatagaatagcaaatatgagagggcatcatacttaaatattgttccatgaaacttatttttcgatcatataaatgtatgtgtgtactgagtcacaagatgaaacattttctgtggattgtattcaaaaaagtgaaaagtaattgctttctgtgaatacaattcataaatcagtatttctctgaatggacctttatgtaaactagatttactagaggaggcattctcttgggtaaaccaaagaaatgaggttactttggcctgatttgctatttttgaaccaacgctgattccaaattgtcactattctaaaaatttcttcctattttttttgttaataatctgttctaaaataacgcttaggataaaattgaaacttttcatgtctatggtttccatactccatatttttactgatttgaaaattgtctatccacagcctttgacacttctttggtttcccttaatttttcagtgattatgaagaataatttcacgtccatcctttatattctttaaggccctgggatgtagtttccttggatctggaaatttgagctcaggtaaaattgccagctgggatctcgttactcttgagcccttcttcctaatctgtggcttttccccatatataatattaaagcaagaaagatatttaggtggactttaaggaagaaatttcaactttcctacaagtaaaatgttgagaacagcttgggagtaggctgggaaggctgtctccaaacttttgagttttcattgggactctctcagtacttgaggctggcgtgtgcatcagattgtcttccaagagtatttccagatctaagactctctaattttattggcaaagcatatcttttagttggaggcccaaatggtaatttttaagaacttcttggataaacatgttcttatcattgcaaacaaatgagaaacaaacctaacaagctctttgcatcaaagatattttaattgctctgcttgaaaaattttaaattaaacaatgagtagaaaaaaagaatatttacataatatgggtatggtaaaaaaaaaaaaaaaaaaaccacaaacacctctacttaccagccagtttaataagaacttaccaaaaaaagagcaaaaactttaccctgtagtccttgctattctttcctttggattcttttcctttcgctatctcctcagaggtaaccaatgtcctaaattttgtatttatcattcctattattttctttatagaatatgtttatatctctaaaaatacattatttacagccgggtaaagtggctcatgcctgtaaccccagcactttgggaggccgaggcaggcagatcacctgaagtcaggagttcaagaacagcctggtcaacatggtgaaactccatctctactaaaaatacaaaaattagctgggcgtggtggcacgtgcctgtaatcctagctacttgggaggctgaggcaggagaattgcttgaaccgaggaagtggatgttgcagtgagccaagatcgcgccactgcactccagcctgggtgacagagcaagactgtatctcaaaaaaaaaaaaaaaaaaaaaaaaaaaccaaaaacaaacaaacaaaaaacattatttacatttgcatgcttttgacttgtgtataaatggacacatgctgaatatagtcttctataacttgcttgcttttcttcacttaacattagattcttaagagttgctcatgttgttacatgcagttgtgattttttcattcacgttatcttgtaagatcccattgtgtaaatatgccatcatttatccatgctactcttgatgtgcattttgggttgttgctagttttatgttcttgtaaacagtgctattgggaagattcttgtctatctcccttgaacaatgtgcaggaatttctctagactaagtacctaggagttgaattgctggataatatgcatacatatctttgactttgttcaataatgccaaattatttactaaggaagttataccaatctaaacttctagcaccaatgtgtatttccattgctcaacatccttgttaacacttgatcttgttatatttttagagttcttccaaactaatgggtcagaaatggtatgactgtggttttaattattgttagtggtattttagtaataatataatagtaataataatatggttattaattctcaggggaaggattttccttctttcactcactgctggggtacaagatgagaacttttctttgtagtccctatacatgggatggatttatttcactctttacactgagagtataggctgttggtatatcagctttatgtaggaggtgagggtgaggggatgtaggcagtctcctctaaaactgatgaccttgaatagtctctggagtttgtcttctgtatccaaggtctcaccagtccatggaaattaaagctcagttttggcagttatcctcagaataaaaggtgagccttaatatctggtacctaatcaggatcctgctttcacagtatttcttactttcttgcaagctaaaagtggatttttttcattgattttcatgtaagcacagccaggctacatggctcaccatactgcctgaaataggatcctaattgcttgactttgaaattgattccattttcaacctttagttactttcaaatgtatttcatgatattgtgccagagcaatctgtaatttgatgtttgaaggacatatgtacctcctcaaattatcctcttcagatttacaaactagaaaattctcagtggagatggctgacctaccacttgttcaagattttacaatgagacaaaaagttgccatttgcaagcatttgaggaaaatttttgggtgttcatcaagggaggagagaaaaagactgcctagggtgtttcccatttgctgcctgctttaatttttcatttataattccttgctcagaatttcattgaagaggggaatttctaggaagcattggcattcatgctctaaaaatgccctgtcttaacttccctaatgcagccttaacaatgatgaagatcccatacccagtttgattgtgctgtgtaaaatttgaatgtgacttgactactacacatagaagaacattaaaagacccatactaacaaaacaattactgacaggttttgttagggctgcaaaatagtgtgtttgcatttccccccctccccacctttcttttttggataggtttcatgtgaattcatgtgagtaccttgattgaattaaataattcatgtaaatcacccaaggcagtgcctgaggtagtgtctgttaactaaatagtaggtatttcttctctcttacaagctaggactgtaaggactgtgttaggactcactggtgtctaccttggccagtaagaccagataagatggtgctgtacaaagctgctcctgcatggtaaaaggctggagaaatagttgctacttcatttaatttaccttttatttccttcttaccctggactttcatctgcacaccaggatgctggaaaattgctcagaaagactcaatttttggcaaagttccctttagggcacatactgcctttttcactggcccatggtttctgagaactgccctcatcgctgcaaatgaggacttcaccagcccctccagtcccttccctgcagacagcctgccttggtcctaggggaaggacaaagggagcctgtcactgcaggcccttctccagcaagggactgggaaggggccaacatgcctgcaggctcctgtattgacaagttgcagcatccttaagagcagccaagaaataaaatggtaatttgtgtttgcatctggaatttctgagcttcaaaatcttggatcacagcactctcaataacagaaaacaggacacacatataaatatccatatccatattagcctctttgttaaactctgtctgggtcagcagctcgagactgaaaagtagcaggatgattgtacaggaagtagaatgaacctgaatgctgtgtttcagggcaggggacagcgggcatgagagggacgagaatggcctccccatttagtggaccctgagccatccccccagggacatctagagtttgactatattatggcttaaaacagctcttatggactctctaggggacctgatcaccactgataatgtggtttccaaggaaaagccaatttcaaattataagcaactgatttataaatgcactttggggatgctgccatctgtaggtgagaggccacatgactcccctgtcatcagtgccctgatactttggcagggttacaagccacgctgtgcctctttgtggggctctctttagctgggcagtgggctaaatgtggtattcgttggatagcaccagaagcctatccatgcaacatattatctccacttgcctgttctgctgcctgaggtttccccatgaggatcaggaagtttccacaatgagaagaaagccatttggggaaccctgtaaaaaactagtgtgttaaggcattatgtaaatatgagagtggataaatgacttagctgatatgtacagcaaagactattctgattatcaacttgggagttctagataaggtgtgtaatacaattgttttcaaactcttttgattgctacctgcagtaagaaatatgttttatatcacaatccaaaacacacacataccatgcacacagtatgccatcaactccaaaactctgtcagtcgtcagtcaccattattttaggtatcactaaaaaagaaaaatgataccaattaaactatgccattccattgattatagagctcatcttgggttcagggaaattaaaatgttaaaaagtgttgttttagagtcaataaaatatggtatatgtgtgtgtgtgtgtgtgtgtgtgtctgtgtataattgaaacaaaagtgtcatgaaacaatgctcacttttactatgtatggtatattataagtatctgctattttcccctattctaatctaatgtattttattgcaaataaagctggtcccactaaatttatggaatggctcactaatgttttaatttaattttaaagtgttaagtctgagctatagtattgttttgaaatagggaattggaaatgatacactgagattgatttcttatctcaaaccagatgtcatgctgtatgttttagtcatctatttcattcaaatgtaaattgatggtctactgtttaagttaggactcttgatggcacatgacagaaaccagtttcgaaaaagctttgaagaaaggatgggcttatcatcttatgttagggcagaggtatgcttgtggggccaagcaatactggaaccaagggctcaaatattgtgggatctctctttctctctttctctgttttgtttttgcttttctttgatggcttcattctctcgaattagcattctgtatgagatttaatctttgtcgttggcagcttcagggctcacatcttcctcattttaccaccagagaaaaatccttccaagattctcattggttcatgtaattggttcatatgattgctcctgtagtcaagggataggataaactcacctctactagaaccacataggtatgaggaataatgcagttttccaaaagaaaggctcttctttctttgagaggaacacaatagatgtctatcacacctaggaagtgctagcaccaggcattgtgtgctggggtgtagcctcacacaacaggtattgccaaaagcctgcagatgatcattttgaaaactagaattgccgtcagcttagttgcaccttcactttcccactagagcttgagtctcccagtgaagataataataactgacaacagctactgtgtgactatcagttcaagggcaccgaatggagaaatcggtgctttcaagagagaagctacccagaaaagaaatgattctacctcccaacacaggcagagctggataaaatagccatctgtaaaaaacttcaagtaaagtccaggtttttgttcttgggtgctcgtgttctattccctgttggggaaccggagaatgttttataaggaagaagccttaggtttcagctgagcagactgcagcctgtcactttcaggcattctcatgatgttcatttcagtgtttcagtgctgttttctggaaatatctttcttcacactctcttctctctgtctctctctgccatttaatgtactatattaaaatatcaatctacagctggcaattaaaagtttgctgcctacaattctcagtacacactgtggcgattttattttattttcttagactctgtcttctctgaattcagttattctcagttttgccaagatgtgccagaattttgtaagttatactgctgggttactgccaagaacgacgtaccagtcgcagctttatttgggcagctttttgtgccttaaatacagtatctgtttctgtaagtacagccttcactgagggagatggatgtctcattctgatattgatggaacagcttgagcatatcagtaatgtgtaggctaaagtctcaaggggaagaaaacttttgagagcctttgttagtttcacaggggcagtaaggggaaacaaaccctgaccgtattccctgaagagtttgatgtctagctgggaagaaaaaactcgaaatggcttctgaaaatccaacgcaacataaaatcagtgctgatttaaaaatgtgaacagagtgcatcaatgtgaatggaatggttaggaaagataaactgggggagctaggctttgaaatagctttaaacacaagaaaggaactgagaggagggaaagggctttcaggtaggtttctgagtcatgaagacagaaacaaggagtgaaattgcatgagatttagaatcagaaaagttcaatccttgttctcctataactgataatcacttcattctctgagctgagaatacaatcataaacaaagtgtcaaagagttgttgccctccccaggtttacattctagtcactgaatgatacctgcctcataaggttgcactgaggacttaaagaggcaatggaaatgaaagaccaggcagatttttaaaatgatgtgccatggtaatttgtttattgccaggtgtagaaggaggagggcaatttgatttgcttgactgctgttgtcccagctagaggttgaggatgggagtgttctagggtaacataatttgaaaacaggtactatgcccttctaaacacttctggtgtcccattttacagatgagcaaactgaggctcaggaaagaaaagtggcttcccaaatcaggatggcactggaacttaatcccagggctttttcagttgcatcctaccagagaggatggccatgagcagttgaggaaactcagtgtctgcttgctgtttcatgggatataacatctatgccctgaacaaatcagataaaagtagacttctaccaccgatcccccaaaggctttctcagattttcagattccttcattctgagggaggaaaccgaattaacttaacaaatgtaggttttcaaagtatttaaatcactgtttttctaatacttttgacaagacccacaggaagaaatatattctactgtgacctattgttagagtgaatatattatttattgtacaaatcaggaaggttttgagtgtgaaagagaatgctattaataataatgttagatggtaaccatgtgaggtgatggatatgttaattagcttgattatggtgattatatcacaatggatacgtatttcaaaacatcatgttgtaaaccttaaatatatataattttgcccattataccccagtaaagctgaaaaagtaatgctgggacaacaggcataaaatgggactgtgctatgcaaactggggataccctaccacacatacacctatataaaaacaaaaattgtacaaagtaaggtttattctttatatgtgcagtgcaccctgacattttcaattctatttcactacaaaaatactagtcatgacctactaaatggggtcaacagtttgaaacatactattcttagttgatggttggtatcgctgaggcacttatgatggtagtaaagacagggatttggtaagctgaatgtctgatatgtcctataaacttgtttcatctgaacattctgttgaatcttctgccacaagaaaagcactggtaataaacattttcttcagttcattccccatgattagcaaaaggtttagactaatctttctggatccctttgttccatttggaacaagaatcttcctctgtgtatttcccctcttttcttactcttgcgcttttatctattagtctgccacttatttagggatgtaaggaatccaaggaagaatgtctcatttacagatcctggttctctgtgtacttgttctgagccttcatcttggggttgaagctggtgctctgaaaagctaaagtttctttttcgctctactccttcaaacatatacacctttacacacaactcctggacatctctcctctgttgaaactttgccaagatataacagaatagatcttgcctgctagtcaggcatacggaactgacttctgggcttcttcaaaagcccccataaattaggactttccagaagagaagcttctgcagatttagctatggaggagagaagggttaccactgtacctgtgtccacacaagctatggacaggccctttgttagcccatttctgtcactagaaatgtttgtacactcacctgtgttaacaagagcttcaagaatacaagagacccggcaatagcacctttcagcaataaaataacttttggtgagtccccattttgtaaatgtttttaagtcataaaggcatatagggaaccacagggtttttcctacctcaaagtgtaaactatggtaatgtcttgagcctaaaaatcactttttcctaaagcaaattttattatctggatcatctgaactcatagagtaaacttgacaacagtttacttttctgaaaaagattgactgtatggcttttcctggtggttattaagatgaatacatatacatatgtttatgaaagattttctaaatcacaaatcatacaggattgttagaggaattttaaaaaacacacagaaaactttggaagcactgagattcttgaccatgtttcatgcttaaactttaaaaagtatatcatgccagatataagtttgtcatatttttacattttttcaagaaactcatttacacagcagctcagggatgtggaggccttcaatttatactcacataattaagtagaaaatgtgattatgaaccctcaaattagaaacttgtaaaactaaaacatatatattatgccatttaatttatggcaaccctgttgaggcatgcctaattggggtatttgaggcttagagagactcagtggctctcttagcttggtttcctagaagcaaagcttatggtttgttgagggaatactctcaggaaaaaaacctataattgaggaagggaagcaagaaagagctaagcaaggatagagtctcaggtaaattctagcaccacagggttcttagaaacataaatactgcaaggttgtccttccactcacctttgggggctagaagtctggcttcatgttcctccatatcaatcaaacattggctgcctccaggaaacaggtggggaggaagaagtggctcctatcagctgaggacaattctctggagaagagggcaactgtgagttatttgcagtcaaaggctcccagcagctaggagatgggcacaccagcctgagtaaaggggatctgattgaggaataagcagtatctaccgcagtgacctaagagaagactattaaaccaaggctgagaggtacatcagaatcttctgactttaaggcaaatgccctttctttttcccttcctccttttgtactttctactcttcctacaccttttcctccttttgttttaaaaacaaatactgtttattatgttagaatttttataagtcaggatctgggcatggtttagctggctcaaggtctctcatgaggttgcaagcaagttattggcttggcctgcagtttcatctgatggctcgacttgtgggtgttatgtgtgtgtgtagctggggagatcttcttataaccttacttatgttattgttggcaggcttttggtccctcaacacatgggccactccacagggcgccctcatgacttggcagctaacttgacccggaatgagtgatccaagagagagagtgtgagacagtattcaagatggacaccacagtctttttataacttgacttcaaaagagatatggtgtcccttctgccaaaatttattcattagaagcaagttaataaattcattccacacttaaagtgaggagttacaaaaggttatgaatgccaggggacagggataattgggggccatcttagaagctgcatatcagagtctaccctctggcacccagtgattatttcccaccaacatgcaaaatatactcactccccccccccttttttttttttttagaaaaatagcatctattcacagctaagcagctcactgagcctgctttctgacagtataattgtaggggatcaaagacctctccttattccttaatgtctctgccttcctaagtcaagctagtgatatttcagcatatataactcttttaagaattttgtgggtctcctgtgaatcttcttagaattcactctattagacaaaagttcaccctattagccaccttacaaatctcatagatatagactcttctctgtttgattgagaggaacttgagatacccttaatctctctaaggggccttttgtaagactgaaggtactttaaggcactaccttgatttaacaaaggattttacagccgtaattttgccttcatctttaaatcatgtttttctggcaatgccttggatttgatctttgttcagaagctattcaaatgtccttcatactgtaccacagctgctctgtaatccattggcagatcatttgttagcactaaatcatctggctcccacaaataaacaccctatggcttccaatagtacaaaatacccttttgtaaacatccaaatctgcagtattgtcacagtttaaatttatatacggaagctggactgattagaataaaaccatccaaaattataagcatgaggacataatttatgtgtcacaagaaatttaaggcagatttttctcttttttctccaacatttttaccaattccaaatcatatactgggtatacaaggtaaattagacatagttcccacccctgagcaatttatagacatgatttatctccatagaatacttttaaaaagttaggtctaggcctgtgctatccagtatggtagctattaaccacatgtggctatttaaatgtaaatttaaattaactaaaattaaatgaaataaaaacattcacttctcttgttttactagccacattttaaatgcttaataaccacataggactagtggctgccgtatttgacagtacagataaagaatatttccatcattgcagaaagttgcattggacagcactaatctagaagaaaccagtatgataagcatttatcctttttaaaaacatatttgcttctctctccccaacactaaaatgagttaaatatcaaaaagaaggacactacatgcttcttcagtaaatattctaacatgcttaacaataaagaatgctgtaagaccatggcttttaaaatttattaaaatctactgaaagctaacatctttttcccctagaaaaagcatgctagtaccaaaaggcatgtatcaaaagcatgtaccaaaaaacatgttcaattacaaggggttcatgggccctccaaagccctttcattaattctgtagtaggccatgatcctcaggttaagaatccctactgcaaagtaaattttattttcccattgactttcagtataaaattgatggtgcaatttactattaaatatgcttctttctgacaatattaaaattatgtctagaataatgatgaagggagaaacaaaatgtaaagaatgaagaactgtcttcaaaatgactaaaaaataaacccaacactttgagctaaaaatataatacagagccagcaaatctaccaatttgggtcaggtatcataatcaataaagaactatgtagttttagcaaatttgccaagttttccattagtcttaaatctctaccacatccctaccttacggtgagaaaccttatggcgtgatagcaggaacactctactagccttcagaaatctagtctcctgatgtaatttcaatacatataataagtattatttaagagtgactttggtgcctcgatgatcttatctacctggacattcagaatgaatgggtggggttccataggccaggaagaccctaatttgaactttggaaaaaaaaagagtggctatttctttgaaaatctgttgaattagagaaagtttttgcaaggagagcaaaattataaatgcagttggctccaggtatggctgagagacagaatcctacatggctctgagtttctgatttctgagccaacgtacaatttgtatttgtgtggaagaagcactgaagcattctttccagagtggtaatctgaaccatatgtagactgattaatagttatgtcataataaaacctcaattagcagaattctagagggatagccttttataaataaaggaaagtttactaagaaacctcccttctcccatcctccccaacttctttctctatttttcttccttttgaaaaattttaatggtggggaaaatctttccccaatgtacataaagctcctctgctgctttagtaagtacagtctactgaacataagtgagtctgtcttcgagcttattgtatctttcagggtgtctattttgcagactagtcatcatatttttatagaagttaatatatgagctcaggctgaaaataaactggaaattttctgagagtggcagctaatacccatttattttcttttcacttaaaaaacacctatcaaggctgagggcagtggctcatgcctgtaatcccagcactttgggaggcccaggcgggcagatcacttgaggtcactagttcgagaccagcctggccaacatggtgaaaccctgtctctagtaaaaatacaaaaattagctgagcgtagtggtgcatgcttgtaatcccagctactcagtaggctgaggcacgagaatctcttggacccaggagatggaggctgcagtaagccgggatcataccactacactccctcctgggcaacagagcgagaccctgtctcaaaaaaaaaaaaaaaatctatcaagaatatgcagtaaagttttcattcatttgtgtatcagtttatatgcatacagttgcatgtaacaaacagtgctattcacagtggcttaaattgaaaggatatttattgttgacctaacaagaattgtggaggtaagatgtataaggttgatgttgtagtctggtgacatcatccaaggtcctgggttctttttatctatccactttgccatcctcaactgaaaatctttagtcctgtgacatcttaccttgtggttgcaaaatggctgctccagcttcagacgtttatccttacacaatagcctccaaagctgaaaggcagaaaagagggaaaagtcttctccttgcgcagttttctcttttatcagggagaaaaatctttcccataagctccctccccctgcccctaagcagacttcattttacttgccattgtccaatattgggttacatgcttatccctggagcaattcctggcaaaggggaattaattttttgacttaagagtcatcatggttcatcgtttggggagggacacattgctgctgaacacaacctgtgatcttttagtaagaaggaaggggagaatggctgctggacaggcaaccagcagcttctgctacacatggattcttcattttgcttctgtgggacccactcttggcatatttgttctcacactactgaagaagccatttgctgtttgcctatcagtgatcccaaagccagctatctcatttctttgaaattgtaggcgcagaaggcagtaaggcctagtgaaaaaagaatgatagatttgaaggccaggcagacaggattcgaatccctgatttaccatttactggctgcataaccttggacaagtaaagacgttagagacttggtttccctaatgataaatctaaaatagtaccaaatggccagtgttattgtatagatttaatgagatagtgcatagaaattgcctagcatagtacacatatcataggcacttagtgtgtgttatttcctttcccatgtgaattcaattgcacagaaatcagattgcatttagcttagcagatagaccaattcggaaaaagagtaagtttgactccagtaggttttttttttcttttttcctccttactcatctatgttcacataaaagtcccctctcttatctacaaaagacttgtgggtagaaagcagtgtgccctgtgttagggtagtgtccagttactaagagaaagctataaaaccatatattcatttcttaattggtttgcttaaatatctgttaggtttaatataggaaacagaatcctctctaggtattttatgcaaaaaatgatttaatgcaggaaataaggtactcacaaaattggaagggctggagcaatggaagtcaagaagtctgcattaaaggtcaaatggcaccatgacttcagtccagatgccagaaactcctcctatcactcaggctaggaaactgttgctgccgtgattatcaccactgccaacgtcactatcctccctaccacacaaagctgatgaggggacagtggacacagttgacaacactcacatctgctgtagcctattttctgcatgcacaactgtagaaaagagttccttccctttgattccttccaaatcactaaaagtagaccctttcacaacctagggataagggaatctagaaactgtacttttcaacccaatgccaggctttcttccgccttacccatgtgaaagccctccttatcttactaatctgtgattcccctgctgggctatctgcccatgtgcattctctctttgcccctgttttccctctatgccctgtttgggctctgacatcctgctctggcctaccatgcctccctgtcctttctggtacagatgtctgccttgctctaaaggccttagaactcagttgttcaagaagagaagattaggaaagggtaagaggtctccttgctttgttaaaaattaccgtacatatctttgtatttcccaacaatttagtgttagaagtttttgaactttataaaaaaggagtcgtatatatagtatatagtcttctgggaccaactttgctcacaatattattttagttttattcatccatattgttgttctcacacatgagctttgccatattttaaaatcttaatgcatttttgcattttgggggttatgcttctttctttattcattcagcattctataatattttcccatgttaagaaacctcttcaaaatgaacattattatgttatgaatggatcataatatgattgaccatttcttgtagttggatatttaagttaattcctatcttagaatgtggtagatgaagaagatagaagaaaaaaaggctgagattttccatgtggcagagtagctggaagatggttatttgctgaaatgggaaacactgggggatgcacaaatttggtgataagaaaaggaatctggttttgagcaggttgagtgtgagtgtggagatatccagacaacagttgaagattctagcttggctcttaggagacagttcaaggctagaaacaatggatttatcatcagtacatggggaatggtttgaggcaagtatgggagtgagatggcccaggaaaatagtctggagatatgtaaaggaccaatactggactcctgggaaatacttatgtccaaatggcaggctgatctagatgtgctgtccagagagtctgtttagaaaggaggaagaaaatcgggaaactgttgtcatttggaagccactgcagaagagagcttcatgaaatgaatgggtagtcattcatactaaatgctgtaaatactgtagacaagttaaccaggatgacaaccgagggcaaaatatatgtatgtgtgtatatgtgtgttggagggctgggcggggggagaaagcttgctgctcatgtatctggatttttttttaatttggatgattgaaggttcacatgcagacatgcagttcaactgtttccttgggtagattcctagaagtggaatgacttgatcaaagggtttgagcataggcctttgattcatgttgttaggtaggtttcctggttttcattgttttttgttttgttttgtttttgagatgggttctcactatgttatccaggctgttttttgaactcctgggctcaagtaattctcccactcagcctccctagtttctgagattacaggcatgagccactgtgtctggttccagtgctcatttttttatatgcaatgatgaatagtttgtaattttgtacacatctgggtgtgcagagacaaggtgaggaaatctgcagcaaaggaaaatacagaattgggcttctgtagttgcgggtcttttcctaatgaacacagtccagccctcatctcctctccactttcagtttccacactctacatctctcatccagaacacaagtggaacagggaccattactcattagctgcatggggatttgaataacctcacagtggaggatgttcttgtctgttatggtggcaagtaactacaactaaatgcgtgaccaagacagagctaactcgagtcattaattagactgtgaagtctggagggaagttctctgaatttaagattacagttttgaagtttggcatctgctaccacttcaaggattaaggatttactgctcactggaattcaatatttaatattttaaaaaccattcagctccagcttgcaaatgagttaaattaaaataatacacagacgttctctctgaggccgtggtttttattggtagcaacgctcattaagaaattttactggctgggcacggtggctcacgcctgtaatcccagcactttgtgaggccgaggcgggcagatcatctgaggtcgggagttcgcgaccagcctgaccaacatggagaaatcccgtctctactaaaaatacaaaattagccaggcatggtggcacatgcctgtaattccagctattcaggaggccgaggcaggagaatcccttgaacccaagaggcggaggttgcggtgagccaaaatcacaccattgcactccagcctagcaacagagtgagactccgtctcaaaaaaaaaaaaaaaaaaagaaattttacttgagccatacgttcatgagaggttctaaataagcacacagatagtctatttcagccttcatttcctacaaatgctgtatatagaagcaactttgtgtttcttttgtcaagataagacatttgatttacctccttatcttgcatttaaatttatttcacaagatggacctgttttcaggtaccataaacacccagttctactgggttttctttgactgctggggaaactgtggactgtgtctgatgcacacattttattgcatctcccctggcatgagattcatatacattggcatcttctcagagtgaagttgactctctctgtttccctattccagaatttcacttggcatatggtgattccaaaacagtttgaggctcattttgcttggtttttggcaatctcagctcagccggtttcactctgagagatctcctgtttgttccttcatgaatggccacagaagcttttgctcttggctctgcattctaatagcacctcctgcatggtctgtggcaaaggaatgctttgaaatatgcgtccatactatgtggcttttcttgctgcagtttctgttcttttttattgtaggatcgggagactcaccactagaagacgatgaagtcgggtattcacaccctagatataaaggtgaatgctttgcttatgtgctaatgaggacctgctggtgccaggagaactttcctttttgccttgtgaaacagattgtaataaagtgaccagacaacacatttaagttctaattatctatcaaggaaaaaaaaatatatatatatactcccttttttaaaaaaggaaataaagcaaaatgcattggaaatctctgaaatgctgtctttcagcatcccaatggtcattttattctcataagtttctttactgtcctcacttctgcaaaggcagctgtagctgatgaaagtgaaaatcaagcctaattcatacattacagccagaatcatccagagtaaaccacctaaggtcaaatctggaccaagtgctgataatgtactaagatgaatggggaaggagaaaacttgattttcataagctcatttcatcgtgctctttctgagcccagcatggcttctgaaacggtatgttaaagtatgttgctcaaatgaaacttaatgataaagaactccatctctacatattcccagcaatccactccccagcacgtataaaaagcctaaacaagaaccttctgtccagactcaggtaagtatgtccacaaatatttctactggtgaaacatttctctgaagcttagggaaacctgggagaaatgaaggtaaatttagagatgctttctctctgaatctagttcctcttacagtggaggaagaatttgaaaaaaaaaaaaaaatggttaacaaagtttcactgcggcattttgccctggaaatttgtcctaattcctgggatgaggacatggcccttgtttgttgtgatgtgtctcagatacaggagaatcagggtaggactggacaacttttgactggagatgtccttcagttgttttctacacaagtgaacaatatttccaatataatgactggtgcctggtgcttatgtgcaggtgtgcttcccatcacataccacatttttttgtgagatctgaatgcaaatactcattcctacctatagtttctatctccatagcctcaggaattaaccaatcaagcaaagcacaaatacgttaatcagatgcttggggtaaggaaaggttctaattcgcaaaacttcttaactatttatgggtttagatttttttttctttgagtcccttgttgaaaaatcttcctaaaacacatgcatgcacagatgacccttcacatctacagcaggggttgcctagtgccctcaggtccttgttcttcacatccatcttcacctcacagcattgcaaatgtgacaggtagaccagatggccaaaatgtgtgcttgccctagaacttaccctgaatgtttaagaataaattttcttagggcattgtttctattgtcagttaaattgcttactggtagcaatcatttcagtatgtataagtatatcaaagcatcatgttgtgcgcttcatacaataaaatttaagttttatttatttttattattattttttgagatggagtctcaccctgtcacccaggctgtagtgcagtggcgtgatcttggctcactgtaacatccgcctcccaggttcaagcgattctcctatcttagcctcccaggtagctgggactacaggcacacgccaccacacccagctaatgttgcatttttagtacagacaggggtttcactatgttggccaggctggtctcgaactcctaacctcaggtgatccacccaccttggcctcccaaagtgctgggattacaggcgtgagccactgcacctggccaagtttttttaattttaaaagctagagacaagccattattaagtgagggtttagttttagatcctgaggcccctgcacaatgtccagcacagagtaagtgtttttgaattaaagtaaaataagaaagaaaattaaatgtaaccaacatttacggtgctcctggtatgtggcaagcatggcttttgattcttttgcttggaataccatcatatattcatattaattgagtgagtttgtgatgtatgagtatgcaggtcatatatatacatacattagttcccccttatctgcggtttcactttccaaggttccatttaccttcagtcaaccgcagccccaaaatattagatattttgagagagagacagtacattcacctaactttcattacagtatattgttataattgttctatattattattagttgttgttaatcttttatcatgcctaatttataaattaaacttcatcataggtatgtttgtgtaagaaacaaacagtatatatagcgttaggtactatccaaggcttcaggcatccaatatcccccgtgggcaaagggggagtactgtatatcacaaatatatgtagtacatacagattatattaaaacccttagaggaaggaaaatttattcaaggaagttctttaggccttgtgtgagctcctacacgtttatatccacatggttaaatttaatcagctctaggttaagcctttaggacatcacctttacctagaaagtccagggaagattacttgagtcttgagtttagggctcacttgcagctgtctgcaaaacatgatatgacgaaagtattagccagaccagggacggtggtgcgtgcctgtagttccagctacttgggaagctgagacaggaggatcacttgagcctaggaggccgagactgcagtgagcaatgatcatgccactacactccagcctgggtgacagagtgagaccctgtttctaaaaaagaaaaaaaaaagagaaagtattagctgaaggaaatgtgaaggcaaaactaaaacagtggtctatgcataagacgtggccagaactgttggtttttgtaactgagaagcagttggaggcatatcctcagaagagaattcctgggaaagtaaaacagggtctgtcctccttcctggccacatgatggcggtcttacctcactcactgacagctcaggtgctgggttggagtgatgagccaggcagttgcagggaagtggctcctattcatggcattgagagcccggcaggctttagggaactcctcactgttccccatcaattgtgggacaatggggcagtggctgctgtaggaacttatccaccaaggagctagtgttgcccttatattttatggatctcaaagagaacatttcaaaagcacagcagggaggttctgatttattcatttcatcccagctgtgctttgggcaactatgagaccaaaatcaaaacacctgcaactttgccatctggggagggtgtcaccctgttacgtaaatggggcataactggggacacttctctatggagagcaattgttctgtgactttaagcgaaatttatatcttgttacaaacacctggaaattgtagcatcatttagattaatgccagtattacaacattttagagagaatgtgcatacggctcagacgaaatccaaattaaccaattattgaatccctaccgctatgtatgacatcagttgcccttgaaagaattatctaaaaaataaaaataaaaaatcttatgtatctagttaagggaaatactaaaaagaacaagcatttattgaacatatatgctaggtactgtgctagatgcttgatatgcaatttttatttcgtccttgtaacagcactatggcataagtatagatattgactcagagaggttagctaacttgtctaagatcacacagtcagttatagaggaactcagattcatgttcagatatatctgacacttagtcccatgatcataacctccctacccggagacacctaagaaaacatggggcactaattgaaggtccaaaatttggaatgtagccagcctgggacagtaagagtaaggggacacattttctgaaagtgtcatttcatatttatctcctcttttgtttctgctacttgtagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacgtgagtaggccagctctgtgttgggtcctcagggatgaccagagccaaagttcttttgctctgagattgaggattttcactgaatattgatgagaaaaattctccttatgatcagggggacaccagggggattctaagatatggtggaagtgagttggctcctctcagagagaatgatatgatcagctgtttgagaaaaggggagagaagatcattgttcagaaaatgagttacatttgttcagttagtgctggatcctgaagaggtgttggggatttagaaacaaataagacgcacatgggtcctgccatgaagaggctttagtaaggcagaggtgtcaactgggagataagtacaagaagggtacaaagtcagggacatatggtagcagattaaagaagagttctcctggctgggcgcagtggctcatgcctgtaatcccagcactttgggaggccgaggcgggtgggttgcctgagctcaggagttcgacaccagcctgagcaacacggtgaaaccccatctctactaaaatacaaaaaattagctgggtgtggcagcgtgcatctgtaatcccagctactcaggaggctgaggcaggagaattgctagaacccgggaggcggaggttgtagtgagccgagattgtgccactgcactccaacctgggtgacagagcaagactccatctcttaaaaaaaaagaaaaaaaaagtgttctcccaaggagtggggcttagggaggcaggaaagagtcacagaagaagtgatgcttatttatgaaagtgagtgtgcctcaagggagaagcttagaggagcagcatttcaggggctggcttttagcttcatgacaagtcatacctcatttggaaaattgcaagtggtacagcattgttgaagcacattttagatgtctttggtattcaaaacagccaccactttttgagcgcttatggtttgccaagaatttcacatacatttgatttttacagtaacactatcaatatgggtgccattatgttaacttcattgtcagggaaactgaggtttcaaggctgcagccatgtcatcgagactatgcagactctgcaactgggtgactgtagtggacaatctgctctacccagatctcctcgatgccttttactagttgtatgtatccagtacccagcttctgagtactttgctcttaaagacttggaacttcaaccttattcagaagactgctccttcagaggactgatcccactcgctctctctctctctcactctctcactctcgttctcttttcacaagagaaagcatctcctgtgagcagcctgtagctgcccaatgactgactgataaagaattatgaaagcccagcttccttgcctgggggcaggacagaatgagctgtcattcacactccagagcttccctatgggatcaggctgctgctgactttgcctgagatctcatcttgcctggatttctccccttccctgttctgctttcctcaccccctcactagtctccctgggagcactttcttactaaacctcatgcacataaatccgtatctcagaatctgcttctggggagctcaacctaagatagtggcttagctgggttgccaacccaagccagtgtgacaggaaactttgtgtcttctgtgtgacataaaaccatccattgtttcttaaattccatttgttttatttatttatacaaagtcgtgttcttgttgcccaggctggagcgcaatggcgcaatctcagctcgccgcaacctctgcctcctgggttcaagcgatcctcctgccgtagcctcccgagtagctgggattacaggcatgcgccaccacgcctggctaattttgtacttttagtagagatggggtttctccatgttggtcaggctggtctcgaactcccgaagtcaggtgatccacctgcctcgacctcccaaagtgctgggattacaggagtgagccactgcgcctggccttcttatatttaaattaacttttcacctcatgctttcagagtttctagactctgaaatgaaactctatagacaaaaactaagaaatgctgaatatctgattttctcattttcagaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtgggtaagaaaatgccacagcccttaggaggcacttgctttgggaggagcagggggtgttcacatcgtggattgtaaagggagcatcactattcctcctgtaaggcctaagcatgcaactttgctctcagtagcatcactggttctctggctcagccctagatctaacctcagtgtctatcctggagctgacttcgtagctgatggcttccatctgacttttgtctttttcttggtttgctattgaggcaactacaggctggcagagatgtggcatactcctgctgattttagttcgggggcctgagcaaagttattgacactatagggacagtccagtagagaacatctatgtgtctttcagccccaatgtagcttctttgtcattgactctggtggtcagcaagcactcaatttgttcagctggaagggatttggatattttgccttactctgggtttgttgggcagtgagtggttcccatggtgtggtcctgggagcagaagcagcagtagcatctcctggtctaagaatgcaaatttttaccaacccacccccaccacctgctgagtcagaaactttaggggtcaggcacagcattttgttttttaatgagcattccagggattgtgaggcactcaaatagagagctactgatctaaggcactgcttctcaaactttactgtgcagcgaagtcctctagggaccttgggaaaaatgcagatttaaattcagcaggtctgcggtgggtcctaggattctgctaaacgatgctttagggcaaagtttctgaacctcagcatgatggacatttggggccaaataattctttgttgtggagccctgttttttttgtttgcaggatgtttagcagcatccttggattttattcactaagtgccagtaacactgcccacagggggcacctcacagatgttgctttcaatatcctccctgtgattagctatgtgcatagctcttcaaaacaaaccaaaaagaaaattgaatctactccctcatattggaaggggcagaggtgatggtgggaggagagaagctcaaaaatctttctgctaagcaagctttggcagagtactctagggatcatactgtttaaatttccagattgtgtgcaacaatggaaagaaaatgctgattgttctcaaaaaccaacagcatgtcttaagctggaccagatgcgcctggaaccttcccagaggaagagagaatgaaccccaaattcaggagattcatattacagtttgtcagaacaaggttcaggcatatttgggagaaggaggattgtacatgcaattagttagggatgacaaaaaggggtacagcgatccacaagagagcctagagctcccaggaaaaaagagagaaatgggcaaagcaagcaggcaattctttctttgattttcgcgacagacaagctgaggtttgtccccagtgaattttactccaggggtattatttacttttttggctttaaatgtattaaaatagtttaataaatttgtttttgtgttgacaggggtagggggtccttgagcgtaactcagaacttcaacctattttaggaggtgacacatagtggctaagtagttcccagatttccacacaaccttcaacagtcttggccagagctgtactgagtggtgagaaagttgtcccagttctcttctagactgtgagggaagagagaagactgggcttactttggactctgaggtggtcagttctgtggtctggctaatttgaaggtgccacaagttaaaattaattctcttacacagaccatactctggcaatgagctgaaattcatagttatttcagaaacagatatagataaaaataagtcaatgtaggaggaaaaaaaatactgcaaattgcaggagggtaaaaagtctttgaagagccacaacctccattgatctggaagaaaataaaccttagaatgtaaccactattgttttcgggggatatttttctttctttccatttttagttatttttggttatgttggcatttagatagaacaatgaacagttggaatcacaacaagtcctcatgtaaagaccagattttgagtagacacatgatctctcctttagaccaacacttcttcctaggccaaaacaggaagaaaacaaattaaagatactttaaaaaccacggacaatgaaaaaccagcaaaggtcttttgacattcagagagtatccatttaattactttaacaaaagacaatgtacaaactttcctttttgccctgtggaacggattgtaataaagtgaccagacaacacatttaagttctaattatctatcaaggaaaaaatatttttaaataaatatattttattttttgctcacttattttttgttttctacagagtagaataggtggagatttattaacacaaatgaaattctggaataaaacattttggagatgtaatatatggaaattgatggcatacgtttcttgtgtcccagctgtctcacagctggtttacccaatgacccataggaatgggatcattgcattattgctgggctgcattgcattattcagttgatgcaaacatcagtagggctaagaatgaatgtatccatgcattgttgcaaatgatgttaaattgtgctaaattcttcctgggttgacaaatacacattcttttgcaaactttcagaggctagtttcagttaaaacaacttgattgactgagatactgattcactttttcccttacatgatttgttagtacaaacagaacaggtcaacttttagtggctctctctaatataaatgtatcaccaatgaatttttatttgggcttctttcttgtgaagatgttgacttttagagatgaggtctcattatgttgcccaggctggcctcttgctatgtcgtccaggctggtcttgaactcccaggcttaagtgatcctcccacatcagcctcctgagtagctggggctacaggcatgagccaccacacccggctatgatcatgacttttaaatgtggatttcattgcctcccttcttgcctcttttgtctgttttggaaagttctctggatttttgtatggtgccaaacagaggaaaccacttcccagagccatccacagagattacgctctggctgggggaagcaaacaactggatgagttttcaatggccaggtttgttctgcatttggcagtcactcacttcctatgcccccttgaaaagaactcttcctttctctatcaccaaactcaaactattttatatttgcatcagtgatctgttgctgcacaatagaccacacaaaacttagtggctccaaacaactatgttattgctcaaagattctatgggttggaaagttgggcagagctctgtggggacagctcatctctgctgtatgtggtaatggttgaggtgaccaagtggagctggaggattcaagatggcttcactcacaggtctggtacctcagttgggaaaagttgtactgactggggtctggctgagtctctttctctctctctctctcatttataatttctcatcctgattacatggcctctccagtcaattggacttctttagatggcagctggcttttaacatagtgaaagcagaaggcaccagattctttgagggcctaggtctggaactggcacagggtcacttcccttgcattttattgttatctgttgggcaagactttgtccttttgagcttcttccttatttccactacctaccgggttagatgtgtcaaggatttccaagtaaatagttcagcttcagctgggtgctggtggctcacacctgtaatcccagcactttgggaggctaagacaggcagatttcttgagcccaggagttcgagaccagcctgggcaacatggcaaaatcctgtctctacaaaaataaataaataaatgaataaataaaatcagctaggcatggtggtgcatgcctgtagtcccagctacttgggaggctgaggtgggaggatcacatgagtctgggaagtcaaggctgcagtgagccgatattgtgccactgcactccagcctgggtgacagagtgagagcctgtctcgaaaaaaaagttcagcttcttagataaatagtagttgatacaatgcaatatatttgtatctcatattttatatgcacagagataactagagcacagagaagggagacagtttgtcagatgtctccaatgaatgtggcagagagcaaaggccagaattttcactgaaggtttcaagatttttatataattgcaggcatcctaattcaacaggggatagtaattatgtttctatagtaactttgttcctttcattcatggaaatgtataacttataaaatgctatcggggccaagtctgggtaataacaggcttaggtctctggagcatcagctgaagggcagaccagcttgtctcaccagccgagagagaaggcagctgcttgaggatgtgtcaggatcaagtcctgcagaggctcttcaagggttcatggggaagctatgacagaccatcacaaaacagtatgtgtgcaaaggttggcggaaaacactaggtcagcagcaggcagatacacaaaagggtttggtttattaaaatagctttaaaatatgtaatggcatttaaaaatcccagaccacaaagaaattccaaaagagaggaaatgcttcttcccagtctataaatgaggatgctaataacactgcttagtctaatgggtggttgtgcaaattcagtaaaataatatagggagggtacttagcatggggtgggcatgtaggaaggagtcctccaatattagttattatttgtaatgatttatttcttcttgtttcttctttggaagagcactgtttctgaaaagctaggccagttcagctgatcattgttagctagagataagctggctttgggaaactctgagactcttcacccagataacctatcttggagcctgtgtgcttacactgttagtacatcttgatacagaaaacaaacaacaatgtatcatccagacatttagtttacctgacagagactaagttgcttttcactctgaccatgctgcaccaagaaaatatggtaacacaatgtaattttacattgaaatctgtatgctaataaatatactttctataatgtaattgccagctatatttgaccagcagggggcagtcattatatacttgtctttctgtgaaatgttcatctgaattataaaagtttgtcttctatcacctatcatagtaaaaaattaaatgtttttaaaaacgtaacagctgagtatagacatcttgaatgcatttaaagcatcttccatttcatcatagtatttgtatactttattttatcaattctgagaagcgtattatttctaccttttaatatccctgaaatagggatgcatttcacaattaggagtgacttagattcaacaaaatatggtggttattcaatttaggattggtgcattaaggctgttaagttcacactccactgaagcacgacatagaatgaaaatgaatttggatagctgaaggcaaaattgtttaataagttattcgtaacttcttaccctgaataaaatgagaaattattagacaagacacaggagaaagtatataaagaattttacttggtgcatttagtctctcaaagacatctgtcattcagaatcaaaaggacatttaactttcattaaggcagtaatagcacttaatacttatcagttgatatgtaaagtaacatgaagctgaatgtccttaatttgctatgccttctttaaatacattctctacctgttcagaaatattaagtagaatttgcagaaatgtgaacttcctcttgtgatttcacttcagctataagatgaaatacaacccagtgtagagttgacatctcatttactttgagccctcattaaccacccatccttgttatcactatcgaggcagaactcctattaccaggtagagaaactacttgaagaaatttgggaggcttttggaggtccagagccacagtaaaactgctgtcccagaacataaaaccataagtgtagttcagtagcagttcaaggggagagtggacccagacagaccattgcctattttaagatattaagcaatatgttgataatagatagcaggaagagagagagcttgttccagtggcaagtgctccgacttagattgtaattcacagtgccattatctacatgtgtggtcttaaataaatcatttaagttctttgagcctcagtttgcacatctgtaaaatgagagagttgggcggctcctctacacctccatagcattcacttttaccttgcctggggcaattgccattttctacctcatgttatatttcatgtgtgataatgtaatccctccaatacatggcaaattctctgaaatgtcaggagcacatgattctcttgcctttgtgcacccccaaccccagcagttggaatgaagccttggataagattggtactcatgaaaaatttgttgccttgaattgaatctgactagatgatagctagaatgcctttctgtaatattccatgatgctgtgttcaaagcaggaagtactcactaaagccaaatgacttctagtttcagctgggtaactgccatgtggccttcggtaggcagagtttggaagcatggggaggaaaggctgtaactaatgaattacccacaggacaccttgcaaggccagttgattgcaggtttagccctgcaaatgtgagtatttaaacaatcttcaaaacttagcaggagagtaaaagcattatgaagggagaaaaggggaatatatagggtgaacaaactctttgaaaatggagaatacccagaggctttggtattttaaactgtgggtgttgaaccccagtttgactagatatttcttgatgatgatgagaatgttttggttatattttcagatatggaacctcctagaatcaagtgcccaagtgtgaaggaacgcattgcagaacccaacaaactgacagtccgggtgtcctgggagacacccgaaggaagagacacagcagatggaattcttactgagtaagtgaaacttggcagataaaatgatgctgtctcttttatgtgagatgtttactacccagagtaggggagtgtatatatgctggtctatttatgctttcagatgtggtccccctggtcactacctaacatactatatatgtcacctatgtatttgttgattgcctgtctctattataatatgttcactgctatgtccttaatgcccagaactgtgcctggcacatagttagcactcagtaaatccttactgaaggaaaaaggagaaataaggggtggtgaatgatgtgattattatgcattgcatgcctgtatcaaaacatcttggctgggtgcggtggctcatgcctgtaatcccagcactttgtgaggacgaggcaggcggatcacttgaggtcagaagtttgagaccagcctggctaacatggtgaaaccccatctctactaaaaatacaaaaattagccaggcatggtggcacacacctgtaatcccagctactcaggaggctgaggcatgagaatcgcttgaacctgtgaggctgaggttgcagtgagccaagattgcaccaccgtgctccagcctgggtgacagagtgagacgccatctcaaaaaaattaaaaaaaaaaatctcatgtaccccataaatatatatacctaccatatactcacaaaaattaaaaataaaaaaaatgtaaaagaaggggtggtgagaagaagggaaggaggaacagaaggggaaagaggaagccagttggttaatttaagaatagagccacccccattgcctgcccaggcagaccctactcatgcccccaggccattacctgcactgggaagccatctgtgtctcccaggtggtgccaaaggctgccgctcttgtgctctgtgagtacagtttagtgcaaaactttttcaccccttgttttttggctgtatttatctctttcaaagctttttaatttatttttaaaactcccgatcatatcaaacacttacagatgcttatttaaaaaaagagaaggtatcttctgctttcttccccacctctaccccattctcctggaccaatttcattcatagtttgacatgtatctgagttgctttttgttggtgtgtttgttttaccaatcacaatgagaagcactgttaagaagcttttaaaaatgggtggatccctttgtgagggttagctatgtgttgttctaatctagcatttgggcctgtacccctgcaactgtttggttggccttcatattccctggagaccactacttcatgttagcacattcatatctgtgccttaaagtttatgggcatattagagttccccactgagttttcatctgtagatgaaaggatacctctaacttatctcctggtgatccataaagcaggaaaagactttctagaatcctatcaacccaggctgtgcatgacaaaacatttttacacaatgattagcaataacagtacagtttctagtgagaggagacaggacattttgttcctacattccaataatcttcccccagtgcctcatctagcttaagtagtattactagttatgctctcccattgtaacttctcaaagataaagtttgaccattaaaaaattatttgctgtcacatacacatcccacaaattcctttggagaaaatgtaggcaatcagaattgaaaagtaagttgatgttatcagggattgggttttatttacctttgactcttcagggtctagcacaatgtctggcccagccccagcacgtagtaggtttttagatttttgcagctctgactgctgttgaaaaaacctgtgtgataaacacaaaacatcaagccatcagatgactctatttgtctacaagctttgtgagaatattcaccttgttctttttatgggtaacttgcgtaatatggttaggagtgttacattttatttgatttttttattttttgagacagattctcactctgttgcccaggctggagtgcagtggcacgatcttggctcacagcaacctccgcctcccaggttcaagtgattctcctgactcagtctcctgagtagctgggattacaggtgtgcaccaccatgccctgctaatttttgtatttttagtagagatgggtttttgccatgttggccaggctggtcttgcactcctgacctcaggtgatctgcctgcctcagcctccaaaagtgctgggattacattcatgagccactgcacccggcaggattgttacattttaaaacagcatctcagtattctcctgtccctttgttcagagcagctgtctgcttccagagttctacaacccagaggccagaaaggcttagagcaggatgtggtgggaatgcactccaacaggatgaggagttcagagaaggctgtcttgttcccttttcgctctcactagggctccttgctgccctggcatttctcctatgaccccttccaccatttcctatccaagctactgctctatcgctcccttgtgagggagaaggttctagtgtcaagctctgagacaagtgcttcttgtgagttcccttatttactccttctgttatttgcatgtcacaggtgaaacaaagtctcagaaaggttacatccacttatatttgaagtatcactcctctcaggtttatctgaatttaaactgtgctttctaaagaccttaaagcatctaaagccaacagcagcatgtctcaaaatagtgggatttctgacattttcccaagacccctctctcatacctggtaaacagccacctcacccacctacatgtaaggctttcctcaatggtgacaatgataattccacgtgttcattattagcaaatattctcatcattcccagaactgtagggagatggggaattatatgtatattgaaaaacagaacgtggattttgatcctgctatacttattggtgtcctcattaggcagccaagaaaaaagataaactcaccctagctgtgtgaccttgggcaagttctttagcctttttgtgcctcagtttcctcatctgtgaatcagagataatactacctaccttatagggttgttggattaaataaggaggattaagtaaatatatgcaaaatgcctagaaccatgcctaacatgtaaggtttatgtaagtgcaaagaacactttttgtcattattattatgttattaggataaccaaggaatcacagagaacttgcctttaggtctccactgtcccagacagaaagaacagagaaagttctagcacccacccccgccccgcaggcccaaattgccagtgactgcttggactatattctctaatgattttcctcacagaaaattccctcgtcttcccaacagtgaggcaattcaggtcccccctggaacaagagtgagattgaaggaggagacttgggccctatatttttcatcctccctcccccctctacccacttccctaccattctacccttcagcaagaaaaaagtctaagcttcccagtagtttgggtcttccattttctggtcacaaactgctcttctaaaacagactaaagcttaggagattctattcttcaagaaatttttgttttatttaaactggtctaatggttgcccctcagtctctccatgtcctgtaaagagtaggggatcgtcacttgcttgtcaggtccataatgtcatctttcctgtttctgattttttttctctaagtgtcattctaaaaggcctccccccaggctccaactttccagaaggagaccacaagatccagtacacagtctatgacagagctgagaataagggcacttgcaaatttcgagttaaagtaagaggtaagagtactgcttattggttttgtttccccctctctttagaagagcaaagggaagtaggtcctcaagccagaactctctcaagtgcctactgtggtgggagacttgccagctttagattagtctctaataaggcttggggaagtgccctatcttaatgcctgaatttcacgatacacatccggatgggcgtcagtgttgccagattatttaaggagttcccaggactagtcttacaggatcccatagctgactgtcctagaagaatattattcaataatttttccatccctgagcttaggtggccagctgaagcctgtgagtccatctacaaccagggtgaataggagccccctaatttgggccaccaggagaacatgtttttagtgttctagtaccattggtatgaaagaaaatgtttttaaggattattttatgcctgatggtttgggcaactaattgctaaccatctttactccttactcttctggacttcacttcctcatctataacactaggggcgaaaccagttgatatcagtggtctcattggtatggatggtgaccattgcaagactcactcactgaccaaatagtcatccctcctccctcactcatttcacaggctgatgtagaagcctgattgcaaagctgatgcctctgcatcctcaccttttctgcttactctgtggatgggagctcagcactgagacccctctggacttgtgtccctacagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcaggtaggtatgccgcccctccagcctgcagcagaacctgtaaaccccttggttcttgattccagtgcaagagaggtttcccttcatatactttgagaagttcatggccatccctctttatctgagtggatgaacatagtccctagatccctgctgcagctcatctcatctgccatccatcttgcccctgcctatcctctaatttccttttcatgtcctctaaggaagaagctcaaggtaggaacctagggccagcctttggtgacattatgaatcagcaaaatttgctctagtttcctttgttctagaaatgtaaggatcttatttataaagctagtaaattgccatgtagagacaatatcatacctgctttgcatcactggcatgaaagttacatagactttgggcatttggaatctttcctcctatgtaaaatgaagaaaataatacctcatctacctcttgagttgtaaggattaaatgaggtcatctgtggaacagtggaatagagcagtgcctggtacaggcaaagccttatgccagctcttattcctgatgaagaaaaattgggctgggtaatgagtctgaaacttggactagccagaaaattatgtatgtatctcttgtttatagacttctctttttctcatttcctggcaccctttcatctttatcactttcttttaattgaagcccccatttagagttaagtgacagagagacatatataccatcagctaaatgcctgagattcttcaatttcatgtattaaagtagaaagaacacacctattatagactccctacctaaggacttcatgcccaccacctatgaggctattctgaattgagatatgctataagtgtaaaatatataccaatttcaaaatcttagtgtgaaaaagaatataaagtatcttaattttttatattgattacatgttgaaatgaaatattttggatatattgggttagataaaacataaaatcatttctacctatctctttatattttttatttgtttgtttgtttgtttgtttgagatgtagtctctctctgtcacccaggctagagtgcagtggcgcgatctcggttcactgcaacctctgcctcccgggttccagtgattctcctgccccagcctcccgagcagctgggactacaggtgcctgccaccacgcctggctaattttttgtatttttagtaaagacggggtttcaccatgttagccaggatggtcttgatctcctgacctcgtgatctgcacgcctcggcctcccaaagtgctgggattacagatgtgagacactgcgcccggtctctttacacttttttaatgaggcaactagaaaatttaagattaaatatagtggcttacattgtatttctcttgaccagagctatcctagactctgagtccctggggcagggaagagggcaggaaagagggcaggaactgtgtatcactcagtgtgacatcctagtacctagcatagagcttggcacatggcaggcactcagtatataatggctgaatgaatgaatgtgtgaatgaacaaatacttcaatgcaaacctaaaatgtgaaatatgaaaaccaagattataaatcatacatggcatctactagtttttctcttattatttcttctctggggctaagccttttgcttgcctatctatacgacatccttcattgaccttgaacagctggaattagttgtcatttatttgcttaaagggaagacctattataaaaccgccttgtcccatgtcctgtttgcctgtgttgtttgctctgtggcctttgtgccccacattgctttgtcccttctgcaccaaggaggcagacttcagagattctgagccattccaaagccagcctggccactgcccattctcttacccttctgcctctctgcacccctttccccagcagatactatggtgcttggcccatatgcctttcacattcccatctgtgttcaaaaggctacttactgcaattaactgggtctgtctgtctgagagcatttctttcctggctatgaaagcattgtcagcccatgcacagagccagctggaagtgatggagagttagtgccccagaagcagccctcagcaatgatggagcaattgtataaatactccagttccctccagtgggttaattctggaggtatgttgtatatcatctcctagagttccccagtgggagtgagttccaaatgcccacagcaaaaacttgcttgataaccaattggtattgttttctttccttcactgtctcacttcctgacatagacagaataatggtccaccaaagatgtccacatcctagtccctggaacctgagaatatgttaccttacatgaaaaaagggactttacagatgtaataagttaaggattttgaaatgggaagagtatcctgaattacccagtgggcccaatgtaatcacaagccttcttatataaaggaggcagaactgatgtcagagtcatagaaagagacgatggaaggagaggtcagagagaagagagatttgaagatgctacactgctgtctttgaagatggaggaagggactactagccaaggaatgaatgtggcctctcgatgctgaaaaagacaagaaatcagattctcccctagaacctccatgggagcatagccctgccaacaccttgattttagctccatgagaccaggatcttttagatcctgacctgcagtatctaaaagaataagtttgtattatgttaagtcactaagtttatggtgatttgttacagcagcaagaggaagtgaatatacttccgtactcctccacaggcgcttcttgggactgcctcccaaataaactgtttacacttgaatccttatctcagggtttacttcttacacaaatggttctgtgtgtcatcataggctctgttgagccagaacaagtggaaggtttctgacccatgtggccatttctgattacagccatgaacgtcaatgtgggtgtcagaacggcagctgcacttctggatcagttttatgagaaaaggagactcctcattgtgtccacacccacagcccgaaacctcctttaccggctccagctaggaatgctgcaggtgagtcctcgaggcagggccaaggtgagagggagacctttaacaggaagggcccagccatttcactaaaagcaaaggccagattcagtgcctaatgcacttacagtgagtttcaggaagtggcactttagagctaccaccattcatttctggttctgggccataacctgattaacattgactccttagagttaacccaatcgttttccaactaatgaggtttgtctgtcttcaccaataagtctaattgacatgctgtccaggcctagccacagaacaattgtctttgccaaacctgtccaggatatgcctggctggaagcaatcaattggttgcctgcccacatttttccccagggaatttctttgactcagagggtgacagccattttttcttagaaaagtggttctcaacgtgtgatccatggaccggaccagaagcatcagcatcacctgggagcttgatagacatgccaattctcagggcccctcccagacctactgtgtcagaatctacacttttaacaaaatctccaggtgattcctaagcactctaaagtttgagggtcacttttctgggaaatgtgtccttctcagctatgtaaattttgtagctactaaatgaggcaaccaacatcttgggtgtgtggggaaggctgactagaaactgtaaggatcaaactagaaattgcttgcttttgtcctgaggctggtttgcaaaagagtggccaacttcactgaatactaaagaggcaggatgtatgctgtgccatggatacagtgctgcacatttttttgagactattttattcatttattacagtggatagaactaagtgcttagaacagtattgatttaatcaaaggctacaatttacttctcatatcagcattaataaaatggataataataagtctcttttcactcttcccacgtacttgaagaattgcctatgaactctgaagagccatataaaatttttgtgagttcccttgataggaaccaaattcattgcatctttacccctggtccccaccagcttacctccccttgtatctccttgtccaagccaggggcttgctcttcagaaaacacaagcttatacctctgtcttttgtgggaaactggcattgcaggctatattccatgatcatgcatttcctcatctcttcttattccataggaaaatgaattaagccaaacaacttgcttttcctctgtgtcagcaaactatggtgacccatggctagtttcggtaaattaacttttattggacacagccacactaattcatttgtgcatgatctacaactgcttttgcactacaatgatgggtgaagtggttaggacagaggcaatccaaccttgccaagcctgaagtactctctggccctttacagagaaagattgccatcgttgctctagtctgtcccatcccttcagacacttgctaacttaacaactggttggataagatattttatatcaagatgttttggtgtgccctcctcctccaaatatacttacatttgcattttaaccagagccttcaaagaaaggtttgattgacttaggcatttcagtgagagtaatacaaaagtctatttctaactttttaaacttttcaaccagttctgtaacctcatatagggacgtttcagtggaattttggtaaaacatatttgatgttttcgtctttcaagacttcaaaatttcttttcccatttagccaaattcatcatatttgtcttacattactttttttttttttattgccattgccattcctgatgagccctcctcgtggttgactgggccacattcccaaggttcttgccaagagccagcttagaggcttggaaccttttatcctcttttcccctgggattgggtgtggagggcatagggcaggggagtgtggagagtggaaacagggcagagaagtggactctggaaatagtcttctctccttgcaaagaaaaattagaatcctctggggtggtcttggatactttttaggaaatttgactcactcaaggtctcaccctgtctggaaatacatagactgcccttttgcttaggttttcaaaatcccactgtcaagccatatctgaatgattcctctagcaaaggtatttaggttttatagccactatcttaaccccaatttctcatctgttttcaggacagttcagagtgagcaaataaacttccagagacaggccagtgctgcttctgtcggtttctagtttgataaggatgtcttttttagccatgctcatacttcccctgttgggttttctttttcccagcaagcacagtgtggccttgatcttcgacacatcaccgtggtggagctggtgggtgtgttcccgactctcattggcaggataggagcaaagattatgcctccagccctagcgctgcagctcaggtagggggaagttctgttcttaaatcttatcccctgtgaatgcatttttaactgattaggttccctggtttctttctattcaggattgagttcaggcaaccttcaatgtttaattgcttttattctgggagtgttataaccatactaatcagtatgttgctgtttgttcaaataaattgtgcagtgggtaattaccagtgttctttcttactccctccaaccaaccgtttttgcttcatgtgtgtgtatgtgtgtgtgtggttggtggaggaaggatggttaggagaggagcacctgaagaaaagacttaagcaatcatggtcttattagaagagcatgcatccaattagacttcccaggcttggtctcttttttctccatgcttccagaacacttgttcatacctttattttaacaattatattttagtttcataacccttacaaagttggagccatggattttagtctctgaataatgatgtattaaagaagcagaattcaacaaccaaaaggtaatttcagaataacccaaatttctacttgcatctcttgaccactgtgaaatcgataattaggctaaagcaaaactccttaaaatcttcctttctcacccagccttttctctcacacactgcatgggagagtacagatctctgttttcagggtcccaggctgctccctgtctctcagggcctcaggcagttacaaacatctcgaacacgtggctttcaggcttctgcaaaagtggggaaagagagtaaaaactcacactgactcctttatgcttcacgttggaggtgccacaccttgctcactctcttagttcattggccagaactagttacatgattgcaattcacttttaagggaggctgggaaatgcagtctttctgtattgccagaaagaagaaaatgaaatgggacttggtaaaccctatcacacctgttcagaaggcacagaaattccttgagaggttatatgatagaaacatatccttagcaaatgatgctatagatagacacaatagcttctttctctaatttccctgttttccagctgcctttgacccatcccatgtttgatttgtaccactttccacccaaaaagattctgccacattcctaccaaggtaaaaaaaaaaaaaaaaaaaaaaaaagaaagaaagaaagaaagaaaaaactcagagggccaggatggaagaaaaataagatgattcatgagttctctttagtcggctgatgaatggagaaggctgggtacactcatatgcttttgtttttgttatattttactgcatttgcatgtagcacctccccataccgacttcagtagcagagctttcaaatattggctactcagtacctagcacagtacctggcaccatgttggcgctaagtggagtaaatgactcaaaatttcattgaaacagccttactatttccagaggtgataatagcttttaaaagtatattgtatatctacagttagtatacaaatacttcaagttgaagtgtacaaaacttaagacagagagttgtgttgatatctaaatatttatggtgaatattttcaaagtaggttttatgaagctgttgcttatttagaactacttgctcatatcctgtgtcaatgattttttaaaacttgttgcagaattttctgaatggtctttggattgaatgtgtgtgtatgtgtgtgtgtatgtcatcttcataaaatcttgatgtgattttaaactgtttaatctacttgaagaacagaaaaatgtgattaaaaaatacttgtcattcagattgtatatattggggctaccatagacttctataggctgaagataatttttaaatacattatgtcgtggttctcaaatttttaacctccatcagaatcccctggagggcttgttaaaatacgtattgctggagtctacactgtaggctctaaactgtgtttctgattcagtaggtctctggtcgtacccgagaatttgcatttctcgtgagctcccaagagaccacatggtgaggaccactggcctagttttttaccaaagcctttacagtttgaaatagaatttttgcccagcagccttcaaggaaagggtcaatcactattttgcagctggatgatagtccaggtaaatgtcatacagaaatgatcactcaggtgcattacctaatggattctgtgtcaggccggcatgcctgtgttatcaaacatatcagtgagaaacaaagagcttggcagaactttttccctttgaattggaaaggtgttttttagacaccttggagtctagtgcagaggaaaaaagatgatttaggcaaagaatgggaagcaaaagaggagaaggaaaagcataatgcctgcataatgtaaaaattctcttgtctggctattttcaaatagcaccaaggccgtgataaaacccttgaagggagtcaacagaaagaagagactgggtgcctggggttgcagggtcaccgcctaccttctttcttaccctcatttcttttttatctggaggtatgatctgattcatgctttccagaggaattttccagcaatctcaaggaagacagggaccaagaaagccatagtttctatacccacattattctttgagtctacagtgttccctggaagactttccaggaagaactccttccaatctgacgacagacacatatgtaactcaggcatactgtcggcatcacacctcatccccgattttgtgtggtgtttgatcattcatccccaagatttctgtggtctttcggccctagtgggatgcattcctgtggctgctgctagcctgctgatccaaccactcagctcttcccatgacagttttccctctttacattctgtgtcaatgaaggcacaagacttacacaggaatgtgtatggtagcagatggtggcaccgtggtggtggtggtgggggttcccatcctagtctcacaagcactataaaaaaaatgaatgctccaatttcttattggtcaccctttcccacaggcttcagccaccacattccctattcctctgtttcctgagagctccctgtaccagaactcctccacgctcccaaaagaaaactcaatatccttccccttaaagatgcagagcattttatctcttcattcacacctttgcagcctacattcgcgtgttcagaactcattaatgcactttgcagtcatctacttctgagctcccctcttagcactgcaggaaacctggcagaggtattgtcatgtcctctttatttcatttctagtcactgggagtgaactggcaatttagctccccactgggataaaatacaaattattcccttcttcctcgaaactccctcttaaaaggcagaaaaaagtagtttgtgttctatgtaatgattttttaaccttgatctgtttgtatgaggaaaacatattttactttaaatccagatggcagtgtatattctgcctcatacataatctcaaaatatctaaactgaaaaaaaaatctggagaagagactgagtgggctcatttattcattgggctcagcttatctgtttgtttgctttctctagctattcccatctaaatatgtttgtgttgatataaaaatcatattttttagtttaaattctagtgtggtagagcagaaagaacaccagacacttgaaaccacttcatattcttttttggaattatttggggtacaaattatgattaatcaagtcagaatacatgggctgtagaccaagctcaatcccttataactctgcagtcctgagctggccactgaacaggccagaactatcatgctgggaaattatatcaatcagctttacctagcccagagtttctcagccttggcactattgctatgtgggaacagataattctttgtttggtggggacagttggctgtgcattgcaagatgtttagcagcattcctggcctctacccactaaatgccggtcacatcttcactctccactgtgacaaccaaaaatatctccagacatggccaaatttcccctgggggtggggagcaaaatcacccctgttcataatcactgactttgtcctagtgtgtatgtggtcgtgcaacactagtcagcaaacgtgggttttgggttgattccaaacttggattgattccaatttaataaaaaaaatctgttagccttgtatgcaccttgtaccaaacgttggtatgtggcaccattgtacgcctgaagtcttcctgactataatctaaaaccaaagcagtgcttttcaacctctcaggtacataccagtcatctggggatcttgatagtaatgcagacactaattcagtaggtttggggttgggcatgagagtctccatttctagcaagttctcatgtgatgctgctggttcaagggtcacagttggagtagacagggtctaaaggatgattcagtccttcattgtatcaaagctttctctgcacactgtcacagtaaggctctggttgatccaccaggacccttgggagtcatggtttgacttagtctcctcttttctttgtctgccacaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggagcaa

SEQ ID NO: 3312 - DNA, 71588 bp, human; identical to SEQ ID NO: 3310

SEQ ID NO: 3313 - DNA, 72101 bp, human
atggactttgacgtcggcagaactacacacctaagttccagtccctgctctgccagtaacgggggtgaatctgggcaagtttctaagcgtcggtgtcttattggagaaagtggacatggtaatagcgaacttggggcatggtcgtgaggatcaaaacagagaacatggccatagtatccggccgcagtgggccactctgaatcccctcggttgccccttctgtttccgtgtgactcacgcagctttctgcacagatggtatccttctagacgtctgggatgttcgaggcggttgtattgaataccgtgtgtgtattccgggtgagggggcgcgcaaattggggcaaagaaagctacttcaggatatttcgctctgctggggcttgtctccagcgctctctggccagaaaaagcgctggcacaaaaggaggaggtgggtgggtcagagccccgaaccgcgcagtgttccagggggggcggagaaaggagggcaggccccaggcaggaaggagggagggaaagaggcgagaggaggagttttccagcccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggtaggatcggaggcgtggctgcctcctcagctgggcaccaaagacccccggagtcgccgttgggacccttcgctcgggatagagggaggtgccgggggcgccctttgtttgcgcagaactcctctttcgcagcccgagggtggggatgatgcggatcggggctggtgtctgggcacgcgccgggaagaactgaccatcccatctccaggcgcggggcgccctcgcggcgacgggagccctagcaccttctgcgtccgggcttccagagttccaatcaaacccttttcggtgtaggaggctccacagagaaagtttggccgcagactagtttgctactttctcacccccagaattttgcctctcacatggttgcccactggaggctggcagcttgtcctggaaggagcctctatgccctcccactacacgtcccaggctacccccttggggccgcaggacacgagccacggtaaagcgacttttgtggaaggcacgggcggggcctcccctgaatctcttaaccccccctgctggggattccgagaaagtctgcgcctctgaggaagaattgccagctgagagtggtgacatgtggcatgcacttgattagccccagggaaagagggctactcgcgcaaggatctgctgggcagagggtgcggcttattcctggagggcgtggtctccggcatctaagggggccctggtgtttcttgggggctctcatggtgtgagcaaaattctctttggagatgcactttaaaaagctccagctaacttcctcaccctggagtcttaggttagcgaagagcttcaggggagtagggcaatgtgccatgcactcctgttgcctcggaatggagaggaaatccatggatgcgttttaatttagtgttaatgggaaagtgggtgacgtcggctatagggcgtgcaaatatttggctctgcgttcaacaccgtgggcagcttaaatctagggtatgagaaatgaacctactgagttctggtagaaggatagaggatgcccatctttctagcagtgtgcttgggagatgtagggatggctgcgggaaattctctgcacgcacctaaataaatgaatgaatagaacaaatttgtaaattaataaacaggaacatttgtgttttgagctgactcttaagttttaagctgctttgtaggaactgattcagggtaaagtggaaaggaaattttatccttactgccaggcaactgttattcccatggtgtgttaatacctcctctcccaccccctttagcaggaatcaggttaaaatgaacctgtaggggaagaggaagtcattaagcgtcccagaagcagctttctgggagcgggcaaataaggtgagaagctagaggtagcttttccgcactgagttgggaggtgcctgtgagctgcctgggaacctcaacttttagttgagcctttctcaagctggggaccccttctccttttccatccgacctccctccgttctcctcccctgccctcccctctcctttctctcatcttccacctttatatagtacagcttgctaccagggcccagccacagaatcatgagttcgccagtttgggcattcactaccacctgtcttttgggacctatccctggctttcctggctccctctgccagcctgcaagctgctcccaacttttagccaccatgttcctgcttgccaccacctccactgactcctaacctgccctccggctctgctcagaccacaaatgagctgaagctgattggagctgcttgataaacactcctcttgagcctccttttggcatggctcaatggggtctcttgggaagtgtgctccgctgaggttgtgagatccagaggaggggatttcagtccaagccagaggctttggaaggctggggaggggaaaatctctaggcccttgggtctgaaagcaaatcacataggctgagttcactctaagtgctgggtgacaaattttaaagatcatttcagagacactctcttagcaagtggacatcatatcttcagtaagagagaaagtgaaggacttgaatctggaacttctgaaagaagatggagatctagggctccatcagcaagtcgattatgtaactatctgcacgtgaatagcacatctgtcagagtgagagtaaatcattctcattcccactcctagaaggtctctggagttcttccatcttagaatttaatgcagcttttctggctctctgatctattttttgcagcctagcaaagatgcagtgtctataaaaacctacatgaagtgtatggaaaatttgtagaaaagttgtttgtgtttgactgtgtttgtatgcttataacagatgagaatttagattctgttcttaaaataattcttagagctgtatttgcatgtgagatagtggtggttcactctgcctccttctgcaaacaaggctgaagatggagaatgagtaccatggcctctaagaaaggcttcgtgaatcttacatctggagaaaactggtaaagtagcgtggttttactagtcaggaaaaccaagtgaggtttgctaaaagccaaaccagactacatcagctgaagcagtcttttgaaataccacatttggagataagtactaggaatggagcacctagctcaggttatataattaaggtgtcaccgggaacaggctaggaattcctatttagatttaaaacatgtaatcagctgacaaaagtactctgcaatgaaaaggaaatatgctggggagagcaggtcattttcctctggcattttcttcattgataacactttcagtacagtacaatgttgtttgttagttactactcatttcgcagatttgggagctgaatgagacaccagaaaccattgttaaagcagcgtcttcacatcttcccacctcatcagtcctcgtaccataaccaaagtgctgcttttctcttttagattattgctataacattctcacttttggtctctctaattctagctcattttactttctcactttagataatggtcttttaagtccattgactttagtactgttttttatcacatcactcccttactcaaaaacttagggcagcaggtccctgttctcactcaagtaaaaagttctcagttgtttttagggggctacacagtttgcttctagcctaattttccagtcttttccccctggtttcctaaaatcctatccttatagaacctgagtcacattttccttcttggcagatgctgctttctgtacctggaatccttcccccttgccatttgtccaaattctgcccatcatccagcaacacccccactttgatgagaccttttcttgatcgctccaatgggaagcaacgtgccttccttttaacacccatggtctcactcatgtctcttatatttatcacatatatcacatatttgataatgctgtatattatcataatttatgcactcttcttcttgtagattttaagaccttggaggcaggggccgtgctatgtcttacccttatttgtatttcccacggtgcctagcagagcactttgtgccacatggatatttgtgcgtaatggattaacagtgcctgtaactccagtgatgggccattggacaggaaaggagctgagggaaacatgtgcacaggtacacagggctttgtgccaccatgaatctacatacatagaaacgatggcttactggatacagaggttccttttaaatatacgaacactctctgtttaagcaataaccttctctgttgggggctgtaagatgagagactgactgcaaccgcaagctggagtttgcatttattatttttgttggccaccttgatctgtgcctttcccaagtggttgaatggtttccttagtaaacgcaaatatgtgtgctacgtcaattcccctttcagagaacacaactgaaattagtaattgaaagtgaagagagaatttgaacagaagaaggtttagttttgccaggctataacatagtatgaaatttgtagcaggcaagttatgattaatgcccaggttagagattcgcttccaaaatagcagcgtgaataataacctctcccaacttccaattcatagggagtttctcaaaccagcccctcagttcttgactgtgtgatgtcttaactgctaacttttatgggccatttgttttaggagggtggtcttttaagcctgaatctctgggaaatttgggtttagttctgaaatagaatcagtttctaccttttctaataaatcctgggctctgcccagagacttatttttaaagtgaacactgaatgatgaagcatttatgtgcttgggagaccacgatgaagaaggtatgcaatttcttctctctcgtagctttctgtcttgtggggaaatagagacatagttatttcaggtggtcaatgttataatacaattggattgacaggcccggggagcacagagaggagctatgtgggaacactggaattggttattgaagaatgatgctgagacttgctggtgcggagatggtggcactaaaggcccaagaaaagtgaaagtagaggatgtgtgggcttctctaagaatgttttgaaattggagacaaaaatctgtgtgagtgtcctttttctggggagacggctctatcccgattcaaaaccactagttactagagcaccttcatgaattctatgagaaaatatgcacttaatgggcagaaaaatcaacatacagagtaagatgaaattaccacagtaggtaaactttgattgaaccagtgagcaggtggcctttccagttacagccagctgtatagtttccagttattttcatttaaaaagcagtaccaagcaaaacagatgtaatcgtaaattgtaattgccttcaggcctgggctggtaacttgctgtacccccctgccccacttagtacacagtgtgacttgggggaggatctttagtcagtatttgtggattaattgattgaagtaattgtgaatcaaagtattccatttcaaatctcccctgtaggatttaaccagaatttccaagatgacactttcctgagaaaacggattgcaagatagctaaatgtcaaaggaaatttgtccatttggacaggcaacgaatcagggcatagttaattgcgaaggctcttggatgtcaaatcaccgtaagacattctaagagacttagaaactcaagggagttctgggggcaggatgtgcagataaagatttagaggaaaagcttgtgcaagagaaaagtccttggtagcactgctaagctcccaagttttccagatgataattggtagcacctggatcttacgggtgtctggcacattctgacctcagaaacctctggagtactcattcccgagctgaatgattcactcacccgtaatccttagctcacaatggatgcttctttatgcattgttctccagggagaagataaatgggtttggacataatggcttggattatcccagaggtttggggttgtaaattgagcataatgattttcaaactttcttctgagtaatagatccaaacatagaatctggggacagactttctgccttggccttgaaatatcattgcaatatttcttctgtcccactcttacagtgacctgtagtgtagtcacatgtactagcagctcatttcccctgctatcactagctgtttgcaatgtacatccagtagtacttaatgagaatctcctcaatgctgattacaccccatgatctgctaatggatgacgctcgcctgccgcttattgtgtgggtggctgagctgaatgaccctgccaatcccagtgatccaagattgttcgcaaacacggttaaattagggccacagggtgagaattaagccaaggtttggcaggcccattgtggagtggtgaggaagcggtggagcggctacatcctccacctcctgagattctgcccacaaagtggcaattccttataggaactctgacagacatgttggtactgactcagtgttagtcagatcaaggctccaattcctttcaatccccaacactgaaattttgtttccacttagattttaattcagctttccaaggagtagggtcattgtgttgcaccattacctattcacggagctgatgcccccagccacgtgagtaggttgtgggatcttgttcatttttgtattctcatggtctagcagggagcctgacttctgggaggctctcagtggatctgtggagtgacatgtgctggggggcatgcctctggccagttctgagcctctgggtgggtgtcttggtctttatctagatttctgcaggagtttctctgttccacacccaggctcccttgcatgggttgcctaattcatggaaccacggaacctcagactgggaggatgcctgagatggtaacttgccctgcattttagggaggagcctctgaggcttagcaagttgaagggatttgtctggggtcacacagagagttaaatgcagagttgggagtagacctcagtctagtggctatagaattcctttcacttcataggcatgcattgaattcaatttttgagtgatccctacatgtcaggcatcctgtggggaaccagagataggcaggcaagaatgaatggcactgagcatttgatatggtttggatctgtgtccccacccaaatctcatgttgaaatgtaatcttcagtgctggaggtgggcctggctggaggtgattggatcatggggggcggatttctcatgaatggtttagcaccatcccctttggtgttatttttgcaatagtaagttaccataatacctggttgttttcaaagtgtgtagcacctccttcctctctctcgctcctgctctggccatgtaagacatgcctgcttctccttcgccttctgccttgattgcaagtttcctgaggcctcctcagaggtagaagctactatacttcctgtacaacctgcagaaccgtgatccagttaaacctcttttctttataaattacccagtctcaagtatttcttcatagcagtgcaaaaatggacgaatacagcattgttcactgagcccctgtccagggtgtatctcagggctattctttatattgacacttggctgtactctcagcatctcatatctagagctgtttggatgtttttcaagagttctgagaagttgctgcctcagtgtcagtccttgccctcttttgaggttgtcagagtcccaaatgcttcctctctataccatttgctttgagctccccaactgatttgtgattaaattcataacagttttattgagatacaattcatgtaccatacctcattcatttaaactgtacaattcaatggtcttagaatattcacagagttgtgcattcatcaccacaaccaattttagaatgttttcattgccccccaaataaactccaaaccttagccatcatttcttaatcccccatccctaggcaaccactaatctattttctgcctctatagatttgcctacaattgaccttccataaaaatggaattacacagtatttatcattttgtgtttggcttctttcacttagtatagtgctttcaaggttcaactgtggcaggatactagccagagtcagccaatggtgcctggccacctctcaatgctggctgcagggccaccactggtgcataaagcacctttgggtgaattagaaaaagaggcccccatctggccacatgtagatctgtggacacagggcttggtcaggagacagactttgggcaagaaaaggatagaggcaggcccaagactcaaggacttgaggccttgagtccaaggattcaagacttggagagtggaggacaggcttgatttgagaccccacttgctctttttgagggtgtgacggtgggtgctgtagtgcagggaactccctgaactatatctatgtagtcctggatgtcagtagcttaactccaagtggacaagctatggaccccatattcttttagagcttgtgactctgtaaaataacaaaacagaaagctgtgcttgcatgccagcagcatctgtggtgaactcttgggtcacctgggagcacgttaaaattgcagaagctcaggcccaaacccaagacctactgaatcagcatcttcattttaacaagatccttccaatgattcttctacatgatgaaatttaggaagtactggtctgatgaatgagttcagcccttggccaagacagagtggcttgcctgtttataactgacacacaatggttcacttcccctcctctcccttttcctgttggctttgccttcatcactgaatcctctgaccttcctttcctaagtccccagcattcctgagataagcatgtacagcctgtaggttaggtttttcctcccttctctaactcaaaaacaaatgcaacctcccttggcttcatctccttttaagcctttctgccaggaatacagcccctgcctggcttagccttgagcagcagcaaagcacatcttcaggctgattggtaacaggggccttgcatggctttttcctgcagctaagatgtattaatacctgatgaataactttagctgtcaagaaaaccaggctagtgtgatcagggccgctcctgccactccggcaagactcctggggctgagaattcctggaactgatcagctcttaaagacacagggacttcttatcttcataccagaaatcaatgacactggggttagcggggaggcagcaccttgggagatgagtgagagtgagaccagtgggttagtcaggaaaacacacagcccctcacattaagcccctcaagctccatgaattggggatgtcaggaagactgaactgttaacagcacttaaagagggtctctcaccttttcagggagttgggtaagtagtagtttccaacccagcaatggtattttttttctctgttcttttcctcttttttttttgaccgagtcttgctctgtcacccaggctggaatgcagtgacatgatctcggctcactgcaacctccacctccaaggttcaagagattctcctgcctcagcctcccgagtagctgggattacaggcgcgtaccaccacacctatctaatttttgtgtttttagtatagatggggtttcaccatgttggccaggctggtctcaaactcctgacctcatgatctgccctcctcggcctcccaaagtgttgggattacaggcgtgagccaccgtgtctggccagcaatggtatttgtacaggctgagtaaggatcacctggggagtctgatgaaatatggtttccctggctccgcctctgtgtattttgatttggtagatctaggttagggaccagtaatctagggtgaaggtctgcaaacaaagtccaggcaggccaaagatggctcactgccagtttttatatgattagttgagctaagaatggttttaacattttaaactgattgaaaaaaaatcaaaagaataataatgttttgtgacaaatgaaaatgatataaaattcaaattttgatgttattggaacacagccatgttcattcctttgggtatttgtctatggctacttggtgatacgatggcagttgaatagttgtgacagagtccatatggcctgcaaagctgaaatattttcctttacagaaaatgtttgccgaacccctaatccaaggccttactcaaagtgtggtttgataaccagcctcacctgggagctttatagaaatgtagaatcttgaacaccatcacagatatgaaataagcacctaccttttaacaagattcctgggtgtttggggctacttcttccccaccacgaggctcagctcaggactcatcttggaggtccaggccagcatgctataactagccttgtatacggttaatttatctgacacataactgggtgtctcattctcaaggtttgaggcttggtagcctcctgatatcttagatgctctaaaaactaggttgctgttttattcttgccaattcttggctaggatccagtgtcctaatctgaggctggaggtggactggcttttgctacctgctgacatatttcttaatgcttcctggatttctagacagcagtctccagatgtgctgccctgccaggatcttggtatgtagtatggcccatagctctccaccgtctcctacttccttccatgaagcactgcttcccagagacattcagaaatggtatatgggaagcaggatgcactgtaatttagttgcaaaaggctgggttaaataggtttctttattgcaggactgctcagggtcattgatatgccagtataccttgttactctctgagagaggacaaggaggaatagtgaggaccacagaatctcaaagtggggtctgtagaccagcagcaacagcagcagcatctcctgggaacctagtagatatatacattctcagaccacaccccagagctactgaatcacaagctgggtatgtgggaagtgggcctagccatctgtattttagcagatcctccaaatgattcttatgtacactcaagtgtgagaaccactggtgtggacgtttccaaatggttttctccgaacatctcactagcctagtgtttcacatttgttgatttcagtgaacactgtgtttttggtttcaggacaggacatttgggaacatgacattgaatttttcctgaagcatttactggtggcagtgaccactgcaggcttggggaggtggaagtggggaagaaaaaaaaccccaacctttgggtagcatcatctgtcccacatctgtctctctagcaattgtgtcttggttaaaggaagtttttttgagacgaaagccaccaacttttgggtgttgccaacatgtgttctttaaaatgtgtttttgtgtattcaaatgtaaagaaagctggggaacagcccttggggtgtttctctctcctcttcacgttacttcctttcagaatactttcttctgtaaaatttcctcatccaaattccaaactcatcttttcaggccagccaagtccaaatggctttcatttgagtgagtgacccttttctccatgggaagcctcaggacacattcagataggagggaagctatggctctcagcatgaggaggctgtgtcttccttctcaaagctcagctcactccctcccattccagaccttcttcctttgccttccatggctagtggtgtcacagccatgggtctgtgtgtgaacactttttagtgtttactctgtgaggatatgtaactgctgtgttgtcacttagtttgaaattctcagtgatagtgaggcttgagggtgagttgggaggaagcactaagttattctacttcctccatgggctggccgctgaggagaggaatgagggttgagaaagccatgcagaccttgattttcagtgaaaatagatgagacaactgacaacttccatttctatgtttttggtgggcagaaaatagatattatcgtttacttttcttggcttggtggtctgaatgctacacatatctataaaatggcccatctgatattgcagatgagctgaaagtatcctctgatgaatgtactttaacaaggctttcaaaaattgtaggctgaccactttttttccaaaattttttgcaaaaaaaaaatatatatatatataggctgagcacagtggctcacacctgtaatcccagcactttgagaggcctaggcgagagaatctcttgagcccaggagtttgagaccagcctgggcaacatcttgggaccctatctctaaaaaaaaaaaaaaaaaaaaagaaattagtcaggtgtgctggcactcacctgtagtcccggctactcaggggctgaggtgggaggatcgcttgaacccaggtggtcaaggctgcagtgagccatgatcatgcactgcactgcagactgggtgatagagtgagtccctttctttaaaataaaattataaaagtaaaacatgctcattatgaaaatattcaaatagaggcataaaaagttgaaagcaggcccacccttcattttcctcttgattccattctctttttctgaaattgccactcagtagtttgatataaacttctggacacttttctgtgcttacgattcttaaacaaaaaaggtaaaaaaggaatgtattgctacatgtaacaacagggatgaatctcatacataatgttcagtgaaataaaccagacacaaaagagtacatatggcaattccatttctacaaagttcaacaacaatgtgcaaaactagtccatggtgttacaagtcagaatagcagttgtctttatggggtagccactgggaggggccacaagggggtcttcaagggtgccagcagtattctgtatcttgatctgggttgggaggtctcatgggtatgcacatacatagaatgtattgagctgtatacacttaagatttgtgcactttactatatatgtttacctcaattataaagaaaaaaatacccacaaatgtatgtgtgggcggggcataaatggatttaagatgtctttgttaaatttccatgccattgcctatgggaactttggaaatatatggtagtgatttgggttgtcataatgatagagaaggccaggcctacacaataaagaattggctcccttagaatgcccatagcgcccacattgaaaaacactgttttaaaagtttgcagactgttctattgggcaggtgttcagaacatggggtaggcctttgaaatagtcttgcctggatctttactctgtctttgtttaaatggagttgaagcctcaagagctgatgtggatggatgggttcttgatttgtttttgccttctgaaccaaattgtaaaggagtggaatcatctcctttgccagggaacagaggcaatttgataaccctcaaatgtgaacttgatgcaagagagagctcttctccagctcagtgtatccctcccatgctcatagctctctgaggccatgtggcctccgccagtgtcttggtctggagtcttctgctgaaagtcttactgcatcctcctttcctttcttagattttctctgtgtcccatttgacctctatagaggagagttaagcatttgaaggaccacatgccacatcacaaattgcttttgttccactgtctggttttactttaaaggctagccctctttttgtctgtctgtgttgactggggacagtcaggctacagagctttgtgaatgccccttggtgagaacaggacttggcatttattgaggtcccctgctttgggctgacctcctcagatttaggtgtttgtcttttttctgtttctcctctctcccatctctgggcaatgggcagggacacactttggcccttcgtagtattaaacaatagaaggagactaaattggaaaaatattattttccccttggaccagagtaatgccttcatttataaagcttttcttttaagtttatttttgttggctctgtaaagtaggaccacaattgatatttcacaagccacatgctgttttaattgtctttgctaatgaaagacagagggcctggggattatgggtgccatggactctgcctagggtcttccttttggggtctgcatagaagagtttgaataagaggatggaatattgtctaatattgcctctgatgaaacagctgtggaagcaaggctgtctctgagagctcatgtctggcagggatcattctctcaccagccagccattctactgccatttatttctggatgaaataaagttaaaatgaacatttaagtgtagcctcaatggggaaagaagttatgtaacggtagtatttggatgccagagagggaggaagagtccccagcaggatggagccccaattgcccacaacagtgactcacagcagttgcccagtgagcagtacccttattgtctttcttctcttcgctgtctctctgctctagtccatcgctatgcttcctgggattgcttcccaaatgaactacttgtactttgtcttagagtgtgcttttgggggaactcagacaatggctaagctggaacttaacccaggattttggtttctggtccagagttctttgtactgctgaattgactcctgctgaatagaactctctaggtcactgaatgaactgtaaagaaggcttctgtgatggacacttggaggttgtttcacttatcttttgatgcataagaaaccactccaaaacttagtggtttaaataagtgacaactatgtatttactcatgatcccgcagtttgggcaggactttgggggacggctcatctctggttcacatggtgttgtctggggtgactcatctgggtctagaggatccgggatggttccactcatgtgtctgtgtctgacacttcatctgggatgactgaaatcgctgggatggctggtccctctctctgcctctctgcagtctgcatagtttagctcttttccatctccccgtgttgccttactctccagcaggaagctggcattacatgcagctggcctcccagtggacaaaagccaaagctaccaggacacttaaggcatagatccagaattgtcacagcatcacttctgttacattctattagtcaaagaaaatcacaaggcaggcccatatttgggatggtggtggtagtggatggagtctacctcttatatgcatgtgcagggtgggaggaattgtcggtggccactgtgcaggcaatccactacagagctggtttgggacggcatattggagatgggagtttaattttccaggatgtttgctgggtgccttctgattagatgctggacctcaggttgctagccaagtgtattaggctgtttagctacagaatgtggcatatgcagattcattgaaagttcatagaagtgagtaaatcagcatccctgggaatatcaaaggctcattttccaatggttattgatactatcaaagacaaagactttattaaacaaaaatgaactcaaaatagatcatagacctaaatataaagcctataaatatgaaacttcttgatgacaacatgggagaaaatctttgtgaacttgagttaggcagagatttcttgaatatgacaccaaaagcatggtctataaaaggtataattgataaattttactttattcaaattaaaaacttctcttccaaagaccccactaagagagtaaaaagaaatatataaagaactctctaaactcaataacaagaaaaaaagccacctaatttttaaagcagacaaaatatttgaacagatacttaaaccaaagatgttcaatattattatccacctgctaactggattaaactcaggcaacttctgctttcgtctgccaactgtgaacaaagccacctgctcttttagggaagtgatttgtaatatacagtgcaaatgtaaggtatggttatacctcccacaaaacaacttgcacacatttctgctccttgtagagggctgactagccattttctctgtctctctcactggactttatgtgacagacacccgcaaattgctagccatggccgttaagtaaccactggccactggcaatttgaggcagatcatttactgtaagctcaagtggacgtgggtgtctcctaccatgcttttccaaaccaggctggtttttaggcctccctaaaaaaatctcccactgcctacttgttctgccctcaagtgtcctgatgtcctttcatttcaaggaacttgcatcatttgagcctgtaacagagggcttttagtcttctttggtactattgatatgtaagaaatgtactttgactttgatgtttttctttgaattcatttgtaagcaatggtaaagtttgaaatgtattacttcatattatcatatattattcttctcaagacctaatgttaaattcaatgctgagtgcttaataaggatactgattacatgagaagtaacagaacagttttcatctagtttctaaatttaggggaaaaaaaagcttggatgaacgccaaataatttcccacttttgtgaatcccaaaggcccctcttcatgcattgaacattcctgaaatttctggaataaaaaaaattgtgagaagaacacacagggtttttaaaaacgactttttacttgaggtgtacttgccatgtaataaactgtactgaattgctttcataccattttcaaaaattaattggaaatttttgtacagatctgtttctgggttctttattctgatccattggtttatgtgcttatttcttcactaataccaatactgtcttgattactgtagttttgtaatatgtcttaaaattgggtagtgtgattcctctaactttattcttctttccaaaattgttttggctataaatttcatataaattttaggatcagtttgtttatatctgcaaaaccttgctagtattctgatggcaattatgtcacacctactgatcagtttgggggagaattgatatccttaatatttgaatctttcaatccatgaatatggtacatctctccatttatttagatattagttgatttctttcacaaacattttttagttttcagtatacagatcccatacatgttttgttagatttataagtatttcattttatggggctactggaaatgtttttattttcttaactttcctctctaatagtttattgcaagtatatagaaatacaattgatttttgtggtttgactttgtatcttgtgatattgctaacctcaagtgttattttgtcgattctttgagattttctacatagacaatcatgtcatctgtgaatagggacaggtttttcctttcttccttcctgccttccttcctttctttctttcttctctccttttgttgcgcaggctggaatgcagtggcacaatctcggcacactgcaacctccacctcccaggttcaagtgattcttccacctcagcctcctgagtagctggaactacaggtgtgcaccaccatgcctggctaatttctgtatttttagtagagatgtggtttcaccacattggccaggctggtcttgaactcctcacctcaggtgatccactcgcctcagcctcccaaagtgctgggattacaggcgtgagctaccgggcctggccagagacaggtttatttcttcctttccaatctttgtatcttttctttctttcttgtcttattgcactggctaggattacctgtatagtgctgaatagggtagtgaaattgagtgttgtgttgttcccagtcttagggggaaagcacctcagtctttcatcgtaaagtataatgttaattgtgggctttctgtagatccccttcatcaggttgaagacattctcttctcttcctagattgctgtaatttttttttttaaatcacgaatggatgttaaatttcgttaaattccttttctgtattaattgatatgatcatctggattttcttctttagtttgttaatgtcatgggttgcattgattaattgatttttgaatattaagctaggcttccactgtcaggatacgtaccatttggtgttaccatattattctttttatgtagtgttgtgttttatttggtaatactttgttggggatttttgcatctgtgttcatgactgatattgtcctgtagttttattttgatgtgaagtccttatctggttttggcatcagagtaatgctagccttgtaaaatgagttgggacatgtgttctccacttcaattttgtggaagacattctgtagaattcttttaaaaatatttgatagaattcaccagtgaaatcactgtgcctggagatttatttttaggaagattatctattcatcttgagtgagttttgatagttcgtgctttttgaagaattggttcatttcatctaagctgtcaaagttatgtgtagagttatacacagtatctgctgtgataccctctgtttcattcctaatattggtaatttgtttcttttctttgtttttctttgtcagtcttgcttgagttttgtcaatgatatgaatattttcaaaaaacagcttttggtttgattgtttccattgtgttgtttcattaatttctacttttgcctttattatttttattatgtcctgctgcatgctttgggtttgttttgttctgtagtttcttaaagtggaagcttaaggtattgttttgaggccttttcctttttctaatataaacatctgatgctgtaaattcccctctgagaactgttttatcccactcactgtactctctctcctctcctttttgaactctattgactgaaatgttaaacatatggatattgtcccacagctccctgaaaaaaccaagattaaaaagaagattgaaaaaaaaagtttattgagcaaggggaagaccaagaaagacaaaaagtcacaaggagtcttcctaccctcttaagaccacatcttctctacagagaaaaaaatctccattcccagagttttaggtatctagagtttgctatacaattgctgtagtcgccactgctgtcactcctgcccactgtcaccacagggttatatgggggctgggtcatgaaataatggagaaaatgaacataaaagaaaaccagggaattttcttcattctctctgaagcattacagttcttcttttccactcttagagtcagagatagagggcttctcctggaactctctctgtacccagtgtctacttctgtgtttgggctgattttagtctagtcctgggataccagagcaacaccaattcagtgttaccccaaattcttttttttttttttttttgagacggagtctcgctctgtcacccaggctggagtgcagtggcgtgatctcagctcactgcaagctccgcctcctgggttcacaccattctcctgcctcagcctcccgagtagctgggactataggcacccaccaccgcacctcgctaattttttgtatttttagtagagacggggtttcaccgtggtctcgatctcctgacctcgtgatctgcccacctcggcctcccaaagtgttgggattacaggcgtgagccaccatgcccggccccaaattcttagtctgcctgctaatgtttactttttcagaatcaccaaagagctgttcagatgcactttgttcaggtttttcagctgcattcagtaggaaagacagggtgaagtacgattactgcatcttacccagaattggaatattgtgacctttttttttttaacattacattatccttttcatggtagtcaggtggttttcttcctcccttccttctttctttctccctttgtttcttcttttctttattttctactttttcttcactatgatgcctagtatattgttagacctggataaataacttttgactgttgcagatggtgaaaagtcttttgtgtgaggttttatagttattacaatttagagaaaggattggattgtttatcattggaaaacactttgttttctaaagatatatctactaggatgagagaagaaaaaatcacgatctaaaaagtggggagtaatagtcttatagagtcactgtgaaagttcagaggaatgatatatttgtaccaggaacaaatatgttacatttgttcctttaagtaaattcagtcccatccaaaaacgtatttattgacattagctcatttttgaaagcctttttaaaatgagctaatatcaataaatatgttaataatgaaaggaacctaacaatgcagaatgattaggcatcaaatgctgtatgtttactgtggtttgaatgtttgtcccctccaaaagtcatgttgagatttaattgctgtagtaacagtattaacaggggacctttaagaggtgattgggccattagggctctgccttcatgaatagattaatgccattatagcaggagtgggttgttagttatctcaagaatgggttcctgataaaagggaggagtttgcctcctctttccctttctgtctcatgtactcccttctgcccttctttcatgagatgatgccgcattaaggcctcaccagataccagtgccctgttctggggctcctcagcctccagaactgtgagctgaatagacttctcctccttattaattacctggtctgtggtattttaacaacagacaatggactaagacagtgtccttcttctgctttattagatagcttatttcaaaagtgaacaagcaatcctgcttgtagtctgagaaatggaaattgtggagttgagggagattcagtaaaagatgatctttcagatgaggctattgttaaacttttcattaaattgcttttattttggccctagtattggtatcatcaaacattaaacagtcttaaaaagtgaaatgatacccagtcatctataaaagagtgaattgtgagaaattatatggcttatttcccagtagagacaagtgatttcacattctgcagcagacccatgagccacacaagtcacatgaaaggtggccatagctcaggtgtttggctcagctttctattctatccaagctatttctaatcacagatgaaccagccacacattcttattttgagcagacatctgaaattgacttcagcttaattgcaataacactgaggattggaaaacatttgtgttaacatctacattctgttcaaaacatcaacaaaagccaaatcccccaaattaataggctcttttgaagacttctcttttgaataaacagtgttgacatgtaattcatcattaactcataaaaacacttcagtaatataaatcaggattgaagtctaaaagccattctgctttcaattagagcatccaaatctggtatacgagaccttttctcctttttttttttttccagccactctgttattttgtcaatctaatctcatctgtatcctgctcacgctctaggaatcaagtctttccctcagatgcaatgcctgcattctaattttaaaagtagttaatagaatataccaattccatgtttaaacaggaagaaactaaggctcctgagaggtgatggggctagccaaagtcacatggctagctagtagcagagctagatgaggattcttagcacctcactccattattttaccctagtcttctagaaagaccctgtgctgttcccagagtctcacctctgaaatatcacactttttttattttttttaattattattattatttttttgagatggagtctcgctctgtcgcccaggctggagtgcagtggcgcgatctcggctcactgcaagctccgcctcccgggttcacgccattctcctgcctcagcctcccgagtagctggaactacaggcgcccgccaccacgcctggctaattttttgtatttttagtagagacggggtttcaccgtgttagccaggatggtctcgatctcctgacctcgtgatccacccgcctcggcctcccaaagtgctgggattacaggcgtgagctactgcgcccagcccacactaaagttttaaattcagtcacaaatgtttttcaataccttataagtatatgaaccaaaaccaacttgtgatgacattaggttggtgcaaaagtaattgcggtttttgccaatggcaatgaaaaaaaacctcaattacttttgcaccagcctgtagacgtcaggatagtggcaggtttctgaccatgttctgtttcttgatctgagttctcttacatgggtgtgttcagtttataacagttcattgaattgtgcactttttaaaaaataaaatatttattacgagtggcttatggtattatccctgattgttgctcgggccccagaacttaatatgttagtaatgtcctttattatgcaacgagtcacctttctcatccagcttaaaaaataattttcctcttaacatttttttattttgctctccagtatacttttgcttcccagcgcctgcctaatgtttgtaccatcagtgttgtagaatcctacttcaaaagaagcatttgctacagcccagaatcatagcggtaatcatgcagtgatcttagcccccaccccagggtgcttgcttgtttgatagtcactgtgagtgttcctaataagccagggcatatctggattcatcatttatcattttctgtgctccaaggctccaacaatatgtgtgataaatagcctgtagcttattttctaaatgacagcagtgaaacctcctgtttttctttctttgaattgaatctgagacacatgaaattggtattctctgaggcttctctcttctccctccccacatttcttttacagcaggggaaaaggcagaaacctaagtttgtgattggtagtggattgaaagccgtagatccttttctcctctccagagctaaggaaatgatcttttgtgagcattcatcactctgcctttttattatttctctctcttacctttagagtcttatttcgtcctgtcctccacctttctgtacaccactccctccccaaaggttgctttttcatagcgtaaaagttgatcctgagtatgtgtgcaagacattatttggtactacaatttcacagaatcatataatcttaaccttggaaagggctgtagagccccaccctacttccctcatctcacccctcttgccagcatccttcggcctcatgggaacacttccagcttcagtaagctttgatggaatctcaagatggtcttggagtcttagaataccctgcctcacactgggctaaaatcagctctacatgacatctagccattgtccttatttctcacttttggtactgcacaaagtaagtttctctctatttttatccatgggatgaccattgagaaatcagaacacagggattctatttccttttagtcccattttcttcaggctacaaatctaaagtttattcaccattcaacaaactttttatttatttgtttacttatttatttgctatgaaagctagtctctgttggtcattttttgttttttctttctagcatcttctggcatgtctgtgtccttctcaaagtgtggccccaagtgataaatatttgaggtgatagatatgtaaattaccccaatttaatcattatgcattgtatgcatatatcaaaatatcactctgtattccataaatatgtacaattataacatgtccaaaaaaaagaaaggaaaaaaaaagaattggcccaaatggtctgttattccagtgtggttgcttcagtctaggataagccagacttctttggtttagcctctgtcctcttgcaggccactgttgctctctcttttttaagaaactatttcacctgctggctcacaatgtgggcaactagctggctgctctttcccaagcctgccagggaagctctcccccttgctgggtgtacagcttagtgtagggagagaaatacaagacttcatgtttataatctctatttaatttctccttgtaggtttcaaactagctatggcctatggtttcatcatctgttggttttgcccatctgtagccaacattgttgatgccctgtgccatctcccctccgcccatctctggattcatctgcagctgaggtagacagttctcaaacatgctgacagtttctcaccttagatgtccacatgtcttagaggctttgcctttagatttactccagtcctgtgggagctcgctcagcaagaatttctggaagagtaggagatgtaacaccccgccagctcttagccaaaaaaaaggcaggagtctgtgggtaaatacccaacctttcgtgtccctgggttgtgtttcctcagaggctcctcagtgggaatgaatccaggttgcccccagaagtaacctgctcattagcatatctttatgggcttttcccctattcctttctcatttcccctgctttctcactgtgcttcctgggatcaccttccaaatgaacaacagcacccaagtccttgtttcagactctgctttgggagaaagaaaactaagagcttgtcctccccagcttggttatcttctacagatttgttcttcttaattcttccttcactggtagaatgacacagagccctatagcatatctcctgagaggaggttacctgttaatgggttgtgaaattcttgtagtggtcatgattagcactttttaaacactcaaatgtaatagaatagcaaatatgagagggcatcatacttaaatattgttccatgaaacttatttttcgatcatataaatgtatgtgtgtactgagtcacaagatgaaacattttctgtggattgtattcaaaaaagtgaaaagtaattgctttctgtgaatacaattcataaatcagtatttctctgaatggacctttatgtaaactagatttactagaggaggcattctcttgggtaaaccaaagaaatgaggttactttggcctgatttgctatttttgaaccaacgctgattccaaattgtcactattctaaaaatttcttcctattttttttgttaataatctgttctaaaataacgcttaggataaaattgaaacttttcatgtctatggtttccatactccatatttttactgatttgaaaattgtctatccacagcctttgacacttctttggtttcccttaatttttcagtgattatgaagaataatttcacgtccatcctttatattctttaaggccctgggatgtagtttccttggatctggaaatttgagctcaggtaaaattgccagctgggatctcgttactcttgagcccttcttcctaatctgtggcttttccccatatataatattaaagcaagaaagatatttaggtggactttaaggaagaaatttcaactttcctacaagtaaaatgttgagaacagcttgggagtaggctgggaaggctgtctccaaacttttgagttttcattgggactctctcagtacttgaggctggcgtgtgcatcagattgtcttccaagagtatttccagatctaagactctctaattttattggcaaagcatatcttttagttggaggcccaaatggtaatttttaagaacttcttggataaacatgttcttatcattgcaaacaaatgagaaacaaacctaacaagctctttgcatcaaagatattttaattgctctgcttgaaaaattttaaattaaacaatgagtagaaaaaaagaatatttacataatatgggtatggtaaaaaaaaaaaaaaaaaaaccacaaacacctctacttaccagccagtttaataagaacttaccaaaaaaagagcaaaaactttaccctgtagtccttgctattctttcctttggattcttttcctttcgctatctcctcagaggtaaccaatgtcctaaattttgtatttatcattcctattattttctttatagaatatgtttatatctctaaaaatacattatttacagccgggtaaagtggctcatgcctgtaaccccagcactttgggaggccgaggcaggcagatcacctgaagtcaggagttcaagaacagcctggtcaacatggtgaaactccatctctactaaaaatacaaaaattagctgggcgtggtggcacgtgcctgtaatcctagctacttgggaggctgaggcaggagaattgcttgaaccgaggaagtggatgttgcagtgagccaagatcgcgccactgcactccagcctgggtgacagagcaagactgtatctcaaaaaaaaaaaaaaaaaaaaaaaaaaaccaaaaacaaacaaacaaaaaacattatttacatttgcatgcttttgacttgtgtataaatggacacatgctgaatatagtcttctataacttgcttgcttttcttcacttaacattagattcttaagagttgctcatgttgttacatgcagttgtgattttttcattcacgttatcttgtaagatcccattgtgtaaatatgccatcatttatccatgctactcttgatgtgcattttgggttgttgctagttttatgttcttgtaaacagtgctattgggaagattcttgtctatctcccttgaacaatgtgcaggaatttctctagactaagtacctaggagttgaattgctggataatatgcatacatatctttgactttgttcaataatgccaaattatttactaaggaagttataccaatctaaacttctagcaccaatgtgtatttccattgctcaacatccttgttaacacttgatcttgttatatttttagagttcttccaaactaatgggtcagaaatggtatgactgtggttttaattattgttagtggtattttagtaataatataatagtaataataatatggttattaattctcaggggaaggattttccttctttcactcactgctggggtacaagatgagaacttttctttgtagtccctatacatgggatggatttatttcactctttacactgagagtataggctgttggtatatcagctttatgtaggaggtgagggtgaggggatgtaggcagtctcctctaaaactgatgaccttgaatagtctctggagtttgtcttctgtatccaaggtctcaccagtccatggaaattaaagctcagttttggcagttatcctcagaataaaaggtgagccttaatatctggtacctaatcaggatcctgctttcacagtatttcttactttcttgcaagctaaaagtggatttttttcattgattttcatgtaagcacagccaggctacatggctcaccatactgcctgaaataggatcctaattgcttgactttgaaattgattccattttcaacctttagttactttcaaatgtatttcatgatattgtgccagagcaatctgtaatttgatgtttgaaggacatatgtacctcctcaaattatcctcttcagatttacaaactagaaaattctcagtggagatggctgacctaccacttgttcaagattttacaatgagacaaaaagttgccatttgcaagcatttgaggaaaatttttgggtgttcatcaagggaggagagaaaaagactgcctagggtgtttcccatttgctgcctgctttaatttttcatttataattccttgctcagaatttcattgaagaggggaatttctaggaagcattggcattcatgctctaaaaatgccctgtcttaacttccctaatgcagccttaacaatgatgaagatcccatacccagtttgattgtgctgtgtaaaatttgaatgtgacttgactactacacatagaagaacattaaaagacccatactaacaaaacaattactgacaggttttgttagggctgcaaaatagtgtgtttgcatttccccccctccccacctttcttttttggataggtttcatgtgaattcatgtgagtaccttgattgaattaaataattcatgtaaatcacccaaggcagtgcctgaggtagtgtctgttaactaaatagtaggtatttcttctctcttacaagctaggactgtaaggactgtgttaggactcactggtgtctaccttggccagtaagaccagataagatggtgctgtacaaagctgctcctgcatggtaaaaggctggagaaatagttgctacttcatttaatttaccttttatttccttcttaccctggactttcatctgcacaccaggatgctggaaaattgctcagaaagactcaatttttggcaaagttccctttagggcacatactgcctttttcactggcccatggtttctgagaactgccctcatcgctgcaaatgaggacttcaccagcccctccagtcccttccctgcagacagcctgccttggtcctaggggaaggacaaagggagcctgtcactgcaggcccttctccagcaagggactgggaaggggccaacatgcctgcaggctcctgtattgacaagttgcagcatccttaagagcagccaagaaataaaatggtaatttgtgtttgcatctggaatttctgagcttcaaaatcttggatcacagcactctcaataacagaaaacaggacacacatataaatatccatatccatattagcctctttgttaaactctgtctgggtcagcagctcgagactgaaaagtagcaggatgattgtacaggaagtagaatgaacctgaatgctgtgtttcagggcaggggacagcgggcatgagagggacgagaatggcctccccatttagtggaccctgagccatccccccagggacatctagagtttgactatattatggcttaaaacagctcttatggactctctaggggacctgatcaccactgataatgtggtttccaaggaaaagccaatttcaaattataagcaactgatttataaatgcactttggggatgctgccatctgtaggtgagaggccacatgactcccctgtcatcagtgccctgatactttggcagggttacaagccacgctgtgcctctttgtggggctctctttagctgggcagtgggctaaatgtggtattcgttggatagcaccagaagcctatccatgcaacatattatctccacttgcctgttctgctgcctgaggtttccccatgaggatcaggaagtttccacaatgagaagaaagccatttggggaaccctgtaaaaaactagtgtgttaaggcattatgtaaatatgagagtggataaatgacttagctgatatgtacagcaaagactattctgattatcaacttgggagttctagataaggtgtgtaatacaattgttttcaaactcttttgattgctacctgcagtaagaaatatgttttatatcacaatccaaaacacacacataccatgcacacagtatgccatcaactccaaaactctgtcagtcgtcagtcaccattattttaggtatcactaaaaaagaaaaatgataccaattaaactatgccattccattgattatagagctcatcttgggttcagggaaattaaaatgttaaaaagtgttgttttagagtcaataaaatatggtatatgtgtgtgtgtgtgtgtgtgtgtgtctgtgtataattgaaacaaaagtgtcatgaaacaatgctcacttttactatgtatggtatattataagtatctgctattttcccctattctaatctaatgtattttattgcaaataaagctggtcccactaaatttatggaatggctcactaatgttttaatttaattttaaagtgttaagtctgagctatagtattgttttgaaatagggaattggaaatgatacactgagattgatttcttatctcaaaccagatgtcatgctgtatgttttagtcatctatttcattcaaatgtaaattgatggtctactgtttaagttaggactcttgatggcacatgacagaaaccagtttcgaaaaagctttgaagaaaggatgggcttatcatcttatgttagggcagaggtatgcttgtggggccaagcaatactggaaccaagggctcaaatattgtgggatctctctttctctctttctctgttttgtttttgcttttctttgatggcttcattctctcgaattagcattctgtatgagatttaatctttgtcgttggcagcttcagggctcacatcttcctcattttaccaccagagaaaaatccttccaagattctcattggttcatgtaattggttcatatgattgctcctgtagtcaagggataggataaactcacctctactagaaccacataggtatgaggaataatgcagttttccaaaagaaaggctcttctttctttgagaggaacacaatagatgtctatcacacctaggaagtgctagcaccaggcattgtgtgctggggtgtagcctcacacaacaggtattgccaaaagcctgcagatgatcattttgaaaactagaattgccgtcagcttagttgcaccttcactttcccactagagcttgagtctcccagtgaagataataataactgacaacagctactgtgtgactatcagttcaagggcaccgaatggagaaatcggtgctttcaagagagaagctacccagaaaagaaatgattctacctcccaacacaggcagagctggataaaatagccatctgtaaaaaacttcaagtaaagtccaggtttttgttcttgggtgctcgtgttctattccctgttggggaaccggagaatgttttataaggaagaagccttaggtttcagctgagcagactgcagcctgtcactttcaggcattctcatgatgttcatttcagtgtttcagtgctgttttctggaaatatctttcttcacactctcttctctctgtctctctctgccatttaatgtactatattaaaatatcaatctacagctggcaattaaaagtttgctgcctacaattctcagtacacactgtggcgattttattttattttcttagactctgtcttctctgaattcagttattctcagttttgccaagatgtgccagaattttgtaagttatactgctgggttactgccaagaacgacgtaccagtcgcagctttatttgggcagctttttgtgccttaaatacagtatctgtttctgtaagtacagccttcactgagggagatggatgtctcattctgatattgatggaacagcttgagcatatcagtaatgtgtaggctaaagtctcaaggggaagaaaacttttgagagcctttgttagtttcacaggggcagtaaggggaaacaaaccctgaccgtattccctgaagagtttgatgtctagctgggaagaaaaaactcgaaatggcttctgaaaatccaacgcaacataaaatcagtgctgatttaaaaatgtgaacagagtgcatcaatgtgaatggaatggttaggaaagataaactgggggagctaggctttgaaatagctttaaacacaagaaaggaactgagaggagggaaagggctttcaggtaggtttctgagtcatgaagacagaaacaaggagtgaaattgcatgagatttagaatcagaaaagttcaatccttgttctcctataactgataatcacttcattctctgagctgagaatacaatcataaacaaagtgtcaaagagttgttgccctccccaggtttacattctagtcactgaatgatacctgcctcataaggttgcactgaggacttaaagaggcaatggaaatgaaagaccaggcagatttttaaaatgatgtgccatggtaatttgtttattgccaggtgtagaaggaggagggcaatttgatttgcttgactgctgttgtcccagctagaggttgaggatgggagtgttctagggtaacataatttgaaaacaggtactatgcccttctaaacacttctggtgtcccattttacagatgagcaaactgaggctcaggaaagaaaagtggcttcccaaatcaggatggcactggaacttaatcccagggctttttcagttgcatcctaccagagaggatggccatgagcagttgaggaaactcagtgtctgcttgctgtttcatgggatataacatctatgccctgaacaaatcagataaaagtagacttctaccaccgatcccccaaaggctttctcagattttcagattccttcattctgagggaggaaaccgaattaacttaacaaatgtaggttttcaaagtatttaaatcactgtttttctaatacttttgacaagacccacaggaagaaatatattctactgtgacctattgttagagtgaatatattatttattgtacaaatcaggaaggttttgagtgtgaaagagaatgctattaataataatgttagatggtaaccatgtgaggtgatggatatgttaattagcttgattatggtgattatatcacaatggatacgtatttcaaaacatcatgttgtaaaccttaaatatatataattttgcccattataccccagtaaagctgaaaaagtaatgctgggacaacaggcataaaatgggactgtgctatgcaaactggggataccctaccacacatacacctatataaaaacaaaaattgtacaaagtaaggtttattctttatatgtgcagtgcaccctgacattttcaattctatttcactacaaaaatactagtcatgacctactaaatggggtcaacagtttgaaacatactattcttagttgatggttggtatcgctgaggcacttatgatggtagtaaagacagggatttggtaagctgaatgtctgatatgtcctataaacttgtttcatctgaacattctgttgaatcttctgccacaagaaaagcactggtaataaacattttcttcagttcattccccatgattagcaaaaggtttagactaatctttctggatccctttgttccatttggaacaagaatcttcctctgtgtatttcccctcttttcttactcttgcgcttttatctattagtctgccacttatttagggatgtaaggaatccaaggaagaatgtctcatttacagatcctggttctctgtgtacttgttctgagccttcatcttggggttgaagctggtgctctgaaaagctaaagtttctttttcgctctactccttcaaacatatacacctttacacacaactcctggacatctctcctctgttgaaactttgccaagatataacagaatagatcttgcctgctagtcaggcatacggaactgacttctgggcttcttcaaaagcccccataaattaggactttccagaagagaagcttctgcagatttagctatggaggagagaagggttaccactgtacctgtgtccacacaagctatggacaggccctttgttagcccatttctgtcactagaaatgtttgtacactcacctgtgttaacaagagcttcaagaatacaagagacccggcaatagcacctttcagcaataaaataacttttggtgagtccccattttgtaaatgtttttaagtcataaaggcatatagggaaccacagggtttttcctacctcaaagtgtaaactatggtaatgtcttgagcctaaaaatcactttttcctaaagcaaattttattatctggatcatctgaactcatagagtaaacttgacaacagtttacttttctgaaaaagattgactgtatggcttttcctggtggttattaagatgaatacatatacatatgtttatgaaagattttctaaatcacaaatcatacaggattgttagaggaattttaaaaaacacacagaaaactttggaagcactgagattcttgaccatgtttcatgcttaaactttaaaaagtatatcatgccagatataagtttgtcatatttttacattttttcaagaaactcatttacacagcagctcagggatgtggaggccttcaatttatactcacataattaagtagaaaatgtgattatgaaccctcaaattagaaacttgtaaaactaaaacatatatattatgccatttaatttatggcaaccctgttgaggcatgcctaattggggtatttgaggcttagagagactcagtggctctcttagcttggtttcctagaagcaaagcttatggtttgttgagggaatactctcaggaaaaaaacctataattgaggaagggaagcaagaaagagctaagcaaggatagagtctcaggtaaattctagcaccacagggttcttagaaacataaatactgcaaggttgtccttccactcacctttgggggctagaagtctggcttcatgttcctccatatcaatcaaacattggctgcctccaggaaacaggtggggaggaagaagtggctcctatcagctgaggacaattctctggagaagagggcaactgtgagttatttgcagtcaaaggctcccagcagctaggagatgggcacaccagcctgagtaaaggggatctgattgaggaataagcagtatctaccgcagtgacctaagagaagactattaaaccaaggctgagaggtacatcagaatcttctgactttaaggcaaatgccctttctttttcccttcctccttttgtactttctactcttcctacaccttttcctccttttgttttaaaaacaaatactgtttattatgttagaatttttataagtcaggatctgggcatggtttagctggctcaaggtctctcatgaggttgcaagcaagttattggcttggcctgcagtttcatctgatggctcgacttgtgggtgttatgtgtgtgtgtagctggggagatcttcttataaccttacttatgttattgttggcaggcttttggtccctcaacacatgggccactccacagggcgccctcatgacttggcagctaacttgacccggaatgagtgatccaagagagagagtgtgagacagtattcaagatggacaccacagtctttttataacttgacttcaaaagagatatggtgtcccttctgccaaaatttattcattagaagcaagttaataaattcattccacacttaaagtgaggagttacaaaaggttatgaatgccaggggacagggataattgggggccatcttagaagctgcatatcagagtctaccctctggcacccagtgattatttcccaccaacatgcaaaatatactcactccccccccccttttttttttttttagaaaaatagcatctattcacagctaagcagctcactgagcctgctttctgacagtataattgtaggggatcaaagacctctccttattccttaatgtctctgccttcctaagtcaagctagtgatatttcagcatatataactcttttaagaattttgtgggtctcctgtgaatcttcttagaattcactctattagacaaaagttcaccctattagccaccttacaaatctcatagatatagactcttctctgtttgattgagaggaacttgagatacccttaatctctctaaggggccttttgtaagactgaaggtactttaaggcactaccttgatttaacaaaggattttacagccgtaattttgccttcatctttaaatcatgtttttctggcaatgccttggatttgatctttgttcagaagctattcaaatgtccttcatactgtaccacagctgctctgtaatccattggcagatcatttgttagcactaaatcatctggctcccacaaataaacaccctatggcttccaatagtacaaaatacccttttgtaaacatccaaatctgcagtattgtcacagtttaaatttatatacggaagctggactgattagaataaaaccatccaaaattataagcatgaggacataatttatgtgtcacaagaaatttaaggcagatttttctcttttttctccaacatttttaccaattccaaatcatatactgggtatacaaggtaaattagacatagttcccacccctgagcaatttatagacatgatttatctccatagaatacttttaaaaagttaggtctaggcctgtgctatccagtatggtagctattaaccacatgtggctatttaaatgtaaatttaaattaactaaaattaaatgaaataaaaacattcacttctcttgttttactagccacattttaaatgcttaataaccacataggactagtggctgccgtatttgacagtacagataaagaatatttccatcattgcagaaagttgcattggacagcactaatctagaagaaaccagtatgataagcatttatcctttttaaaaacatatttgcttctctctccccaacactaaaatgagttaaatatcaaaaagaaggacactacatgcttcttcagtaaatattctaacatgcttaacaataaagaatgctgtaagaccatggcttttaaaatttattaaaatctactgaaagctaacatctttttcccctagaaaaagcatgctagtaccaaaaggcatgtatcaaaagcatgtaccaaaaaacatgttcaattacaaggggttcatgggccctccaaagccctttcattaattctgtagtaggccatgatcctcaggttaagaatccctactgcaaagtaaattttattttcccattgactttcagtataaaattgatggtgcaatttactattaaatatgcttctttctgacaatattaaaattatgtctagaataatgatgaagggagaaacaaaatgtaaagaatgaagaactgtcttcaaaatgactaaaaaataaacccaacactttgagctaaaaatataatacagagccagcaaatctaccaatttgggtcaggtatcataatcaataaagaactatgtagttttagcaaatttgccaagttttccattagtcttaaatctctaccacatccctaccttacggtgagaaaccttatggcgtgatagcaggaacactctactagccttcagaaatctagtctcctgatgtaatttcaatacatataataagtattatttaagagtgactttggtgcctcgatgatcttatctacctggacattcagaatgaatgggtggggttccataggccaggaagaccctaatttgaactttggaaaaaaaaagagtggctatttctttgaaaatctgttgaattagagaaagtttttgcaaggagagcaaaattataaatgcagttggctccaggtatggctgagagacagaatcctacatggctctgagtttctgatttctgagccaacgtacaatttgtatttgtgtggaagaagcactgaagcattctttccagagtggtaatctgaaccatatgtagactgattaatagttatgtcataataaaacctcaattagcagaattctagagggatagccttttataaataaaggaaagtttactaagaaacctcccttctcccatcctccccaacttctttctctatttttcttccttttgaaaaattttaatggtggggaaaatctttccccaatgtacataaagctcctctgctgctttagtaagtacagtctactgaacataagtgagtctgtcttcgagcttattgtatctttcagggtgtctattttgcagactagtcatcatatttttatagaagttaatatatgagctcaggctgaaaataaactggaaattttctgagagtggcagctaatacccatttattttcttttcacttaaaaaacacctatcaaggctgagggcagtggctcatgcctgtaatcccagcactttgggaggcccaggcgggcagatcacttgaggtcactagttcgagaccagcctggccaacatggtgaaaccctgtctctagtaaaaatacaaaaattagctgagcgtagtggtgcatgcttgtaatcccagctactcagtaggctgaggcacgagaatctcttggacccaggagatggaggctgcagtaagccgggatcataccactacactccctcctgggcaacagagcgagaccctgtctcaaaaaaaaaaaaaaaatctatcaagaatatgcagtaaagttttcattcatttgtgtatcagtttatatgcatacagttgcatgtaacaaacagtgctattcacagtggcttaaattgaaaggatatttattgttgacctaacaagaattgtggaggtaagatgtataaggttgatgttgtagtctggtgacatcatccaaggtcctgggttctttttatctatccactttgccatcctcaactgaaaatctttagtcctgtgacatcttaccttgtggttgcaaaatggctgctccagcttcagacgtttatccttacacaatagcctccaaagctgaaaggcagaaaagagggaaaagtcttctccttgcgcagttttctcttttatcagggagaaaaatctttcccataagctccctccccctgcccctaagcagacttcattttacttgccattgtccaatattgggttacatgcttatccctggagcaattcctggcaaaggggaattaattttttgacttaagagtcatcatggttcatcgtttggggagggacacattgctgctgaacacaacctgtgatcttttagtaagaaggaaggggagaatggctgctggacaggcaaccagcagcttctgctacacatggattcttcattttgcttctgtgggacccactcttggcatatttgttctcacactactgaagaagccatttgctgtttgcctatcagtgatcccaaagccagctatctcatttctttgaaattgtaggcgcagaaggcagtaaggcctagtgaaaaaagaatgatagatttgaaggccaggcagacaggattcgaatccctgatttaccatttactggctgcataaccttggacaagtaaagacgttagagacttggtttccctaatgataaatctaaaatagtaccaaatggccagtgttattgtatagatttaatgagatagtgcatagaaattgcctagcatagtacacatatcataggcacttagtgtgtgttatttcctttcccatgtgaattcaattgcacagaaatcagattgcatttagcttagcagatagaccaattcggaaaaagagtaagtttgactccagtaggttttttttttcttttttcctccttactcatctatgttcacataaaagtcccctctcttatctacaaaagacttgtgggtagaaagcagtgtgccctgtgttagggtagtgtccagttactaagagaaagctataaaaccatatattcatttcttaattggtttgcttaaatatctgttaggtttaatataggaaacagaatcctctctaggtattttatgcaaaaaatgatttaatgcaggaaataaggtactcacaaaattggaagggctggagcaatggaagtcaagaagtctgcattaaaggtcaaatggcaccatgacttcagtccagatgccagaaactcctcctatcactcaggctaggaaactgttgctgccgtgattatcaccactgccaacgtcactatcctccctaccacacaaagctgatgaggggacagtggacacagttgacaacactcacatctgctgtagcctattttctgcatgcacaactgtagaaaagagttccttccctttgattccttccaaatcactaaaagtagaccctttcacaacctagggataagggaatctagaaactgtacttttcaacccaatgccaggctttcttccgccttacccatgtgaaagccctccttatcttactaatctgtgattcccctgctgggctatctgcccatgtgcattctctctttgcccctgttttccctctatgccctgtttgggctctgacatcctgctctggcctaccatgcctccctgtcctttctggtacagatgtctgccttgctctaaaggccttagaactcagttgttcaagaagagaagattaggaaagggtaagaggtctccttgctttgttaaaaattaccgtacatatctttgtatttcccaacaatttagtgttagaagtttttgaactttataaaaaaggagtcgtatatatagtatatagtcttctgggaccaactttgctcacaatattattttagttttattcatccatattgttgttctcacacatgagctttgccatattttaaaatcttaatgcatttttgcattttgggggttatgcttctttctttattcattcagcattctataatattttcccatgttaagaaacctcttcaaaatgaacattattatgttatgaatggatcataatatgattgaccatttcttgtagttggatatttaagttaattcctatcttagaatgtggtagatgaagaagatagaagaaaaaaaggctgagattttccatgtggcagagtagctggaagatggttatttgctgaaatgggaaacactgggggatgcacaaatttggtgataagaaaaggaatctggttttgagcaggttgagtgtgagtgtggagatatccagacaacagttgaagattctagcttggctcttaggagacagttcaaggctagaaacaatggatttatcatcagtacatggggaatggtttgaggcaagtatgggagtgagatggcccaggaaaatagtctggagatatgtaaaggaccaatactggactcctgggaaatacttatgtccaaatggcaggctgatctagatgtgctgtccagagagtctgtttagaaaggaggaagaaaatcgggaaactgttgtcatttggaagccactgcagaagagagcttcatgaaatgaatgggtagtcattcatactaaatgctgtaaatactgtagacaagttaaccaggatgacaaccgagggcaaaatatatgtatgtgtgtatatgtgtgttggagggctgggcggggggagaaagcttgctgctcatgtatctggatttttttttaatttggatgattgaaggttcacatgcagacatgcagttcaactgtttccttgggtagattcctagaagtggaatgacttgatcaaagggtttgagcataggcctttgattcatgttgttaggtaggtttcctggttttcattgttttttgttttgttttgtttttgagatgggttctcactatgttatccaggctgttttttgaactcctgggctcaagtaattctcccactcagcctccctagtttctgagattacaggcatgagccactgtgtctggttccagtgctcatttttttatatgcaatgatgaatagtttgtaattttgtacacatctgggtgtgcagagacaaggtgaggaaatctgcagcaaaggaaaatacagaattgggcttctgtagttgcgggtcttttcctaatgaacacagtccagccctcatctcctctccactttcagtttccacactctacatctctcatccagaacacaagtggaacagggaccattactcattagctgcatggggatttgaataacctcacagtggaggatgttcttgtctgttatggtggcaagtaactacaactaaatgcgtgaccaagacagagctaactcgagtcattaattagactgtgaagtctggagggaagttctctgaatttaagattacagttttgaagtttggcatctgctaccacttcaaggattaaggatttactgctcactggaattcaatatttaatattttaaaaaccattcagctccagcttgcaaatgagttaaattaaaataatacacagacgttctctctgaggccgtggtttttattggtagcaacgctcattaagaaattttactggctgggcacggtggctcacgcctgtaatcccagcactttgtgaggccgaggcgggcagatcatctgaggtcgggagttcgcgaccagcctgaccaacatggagaaatcccgtctctactaaaaatacaaaattagccaggcatggtggcacatgcctgtaattccagctattcaggaggccgaggcaggagaatcccttgaacccaagaggcggaggttgcggtgagccaaaatcacaccattgcactccagcctagcaacagagtgagactccgtctcaaaaaaaaaaaaaaaaaaagaaattttacttgagccatacgttcatgagaggttctaaataagcacacagatagtctatttcagccttcatttcctacaaatgctgtatatagaagcaactttgtgtttcttttgtcaagataagacatttgatttacctccttatcttgcatttaaatttatttcacaagatggacctgttttcaggtaccataaacacccagttctactgggttttctttgactgctggggaaactgtggactgtgtctgatgcacacattttattgcatctcccctggcatgagattcatatacattggcatcttctcagagtgaagttgactctctctgtttccctattccagaatttcacttggcatatggtgattccaaaacagtttgaggctcattttgcttggtttttggcaatctcagctcagccggtttcactctgagagatctcctgtttgttccttcatgaatggccacagaagcttttgctcttggctctgcattctaatagcacctcctgcatggtctgtggcaaaggaatgctttgaaatatgcgtccatactatgtggcttttcttgctgcagtttctgttcttttttattgtaggatcgggagactcaccactagaagacgatgaagtcgggtattcacaccctagatataaaggtgaatgctttgcttatgtgctaatgaggacctgctggtgccaggagaactttcctttttgccttgtgaaacagattgtaataaagtgaccagacaacacatttaagttctaattatctatcaaggaaaaaaaaatatatatatatactcccttttttaaaaaaggaaataaagcaaaatgcattggaaatctctgaaatgctgtctttcagcatcccaatggtcattttattctcataagtttctttactgtcctcacttctgcaaaggcagctgtagctgatgaaagtgaaaatcaagcctaattcatacattacagccagaatcatccagagtaaaccacctaaggtcaaatctggaccaagtgctgataatgtactaagatgaatggggaaggagaaaacttgattttcataagctcatttcatcgtgctctttctgagcccagcatggcttctgaaacggtatgttaaagtatgttgctcaaatgaaacttaatgataaagaactccatctctacatattcccagcaatccactccccagcacgtataaaaagcctaaacaagaaccttctgtccagactcaggtaagtatgtccacaaatatttctactggtgaaacatttctctgaagcttagggaaacctgggagaaatgaaggtaaatttagagatgctttctctctgaatctagttcctcttacagtggaggaagaatttgaaaaaaaaaaaaaaatggttaacaaagtttcactgcggcattttgccctggaaatttgtcctaattcctgggatgaggacatggcccttgtttgttgtgatgtgtctcagatacaggagaatcagggtaggactggacaacttttgactggagatgtccttcagttgttttctacacaagtgaacaatatttccaatataatgactggtgcctggtgcttatgtgcaggtgtgcttcccatcacataccacatttttttgtgagatctgaatgcaaatactcattcctacctatagtttctatctccatagcctcaggaattaaccaatcaagcaaagcacaaatacgttaatcagatgcttggggtaaggaaaggttctaattcgcaaaacttcttaactatttatgggtttagatttttttttctttgagtcccttgttgaaaaatcttcctaaaacacatgcatgcacagatgacccttcacatctacagcaggggttgcctagtgccctcaggtccttgttcttcacatccatcttcacctcacagcattgcaaatgtgacaggtagaccagatggccaaaatgtgtgcttgccctagaacttaccctgaatgtttaagaataaattttcttagggcattgtttctattgtcagttaaattgcttactggtagcaatcatttcagtatgtataagtatatcaaagcatcatgttgtgcgcttcatacaataaaatttaagttttatttatttttattattattttttgagatggagtctcaccctgtcacccaggctgtagtgcagtggcgtgatcttggctcactgtaacatccgcctcccaggttcaagcgattctcctatcttagcctcccaggtagctgggactacaggcacacgccaccacacccagctaatgttgcatttttagtacagacaggggtttcactatgttggccaggctggtctcgaactcctaacctcaggtgatccacccaccttggcctcccaaagtgctgggattacaggcgtgagccactgcacctggccaagtttttttaattttaaaagctagagacaagccattattaagtgagggtttagttttagatcctgaggcccctgcacaatgtccagcacagagtaagtgtttttgaattaaagtaaaataagaaagaaaattaaatgtaaccaacatttacggtgctcctggtatgtggcaagcatggcttttgattcttttgcttggaataccatcatatattcatattaattgagtgagtttgtgatgtatgagtatgcaggtcatatatatacatacattagttcccccttatctgcggtttcactttccaaggttccatttaccttcagtcaaccgcagccccaaaatattagatattttgagagagagacagtacattcacctaactttcattacagtatattgttataattgttctatattattattagttgttgttaatcttttatcatgcctaatttataaattaaacttcatcataggtatgtttgtgtaagaaacaaacagtatatatagcgttaggtactatccaaggcttcaggcatccaatatcccccgtgggcaaagggggagtactgtatatcacaaatatatgtagtacatacagattatattaaaacccttagaggaaggaaaatttattcaaggaagttctttaggccttgtgtgagctcctacacgtttatatccacatggttaaatttaatcagctctaggttaagcctttaggacatcacctttacctagaaagtccagggaagattacttgagtcttgagtttagggctcacttgcagctgtctgcaaaacatgatatgacgaaagtattagccagaccagggacggtggtgcgtgcctgtagttccagctacttgggaagctgagacaggaggatcacttgagcctaggaggccgagactgcagtgagcaatgatcatgccactacactccagcctgggtgacagagtgagaccctgtttctaaaaaagaaaaaaaaaagagaaagtattagctgaaggaaatgtgaaggcaaaactaaaacagtggtctatgcataagacgtggccagaactgttggtttttgtaactgagaagcagttggaggcatatcctcagaagagaattcctgggaaagtaaaacagggtctgtcctccttcctggccacatgatggcggtcttacctcactcactgacagctcaggtgctgggttggagtgatgagccaggcagttgcagggaagtggctcctattcatggcattgagagcccggcaggctttagggaactcctcactgttccccatcaattgtgggacaatggggcagtggctgctgtaggaacttatccaccaaggagctagtgttgcccttatattttatggatctcaaagagaacatttcaaaagcacagcagggaggttctgatttattcatttcatcccagctgtgctttgggcaactatgagaccaaaatcaaaacacctgcaactttgccatctggggagggtgtcaccctgttacgtaaatggggcataactggggacacttctctatggagagcaattgttctgtgactttaagcgaaatttatatcttgttacaaacacctggaaattgtagcatcatttagattaatgccagtattacaacattttagagagaatgtgcatacggctcagacgaaatccaaattaaccaattattgaatccctaccgctatgtatgacatcagttgcccttgaaagaattatctaaaaaataaaaataaaaaatcttatgtatctagttaagggaaatactaaaaagaacaagcatttattgaacatatatgctaggtactgtgctagatgcttgatatgcaatttttatttcgtccttgtaacagcactatggcataagtatagatattgactcagagaggttagctaacttgtctaagatcacacagtcagttatagaggaactcagattcatgttcagatatatctgacacttagtcccatgatcataacctccctacccggagacacctaagaaaacatggggcactaattgaaggtccaaaatttggaatgtagccagcctgggacagtaagagtaaggggacacattttctgaaagtgtcatttcatatttatctcctcttttgtttctgctacttgtagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacgtgagtaggccagctctgtgttgggtcctcagggatgaccagagccaaagttcttttgctctgagattgaggattttcactgaatattgatgagaaaaattctccttatgatcagggggacaccagggggattctaagatatggtggaagtgagttggctcctctcagagagaatgatatgatcagctgtttgagaaaaggggagagaagatcattgttcagaaaatgagttacatttgttcagttagtgctggatcctgaagaggtgttggggatttagaaacaaataagacgcacatgggtcctgccatgaagaggctttagtaaggcagaggtgtcaactgggagataagtacaagaagggtacaaagtcagggacatatggtagcagattaaagaagagttctcctggctgggcgcagtggctcatgcctgtaatcccagcactttgggaggccgaggcgggtgggttgcctgagctcaggagttcgacaccagcctgagcaacacggtgaaaccccatctctactaaaatacaaaaaattagctgggtgtggcagcgtgcatctgtaatcccagctactcaggaggctgaggcaggagaattgctagaacccgggaggcggaggttgtagtgagccgagattgtgccactgcactccaacctgggtgacagagcaagactccatctcttaaaaaaaaagaaaaaaaaagtgttctcccaaggagtggggcttagggaggcaggaaagagtcacagaagaagtgatgcttatttatgaaagtgagtgtgcctcaagggagaagcttagaggagcagcatttcaggggctggcttttagcttcatgacaagtcatacctcatttggaaaattgcaagtggtacagcattgttgaagcacattttagatgtctttggtattcaaaacagccaccactttttgagcgcttatggtttgccaagaatttcacatacatttgatttttacagtaacactatcaatatgggtgccattatgttaacttcattgtcagggaaactgaggtttcaaggctgcagccatgtcatcgagactatgcagactctgcaactgggtgactgtagtggacaatctgctctacccagatctcctcgatgccttttactagttgtatgtatccagtacccagcttctgagtactttgctcttaaagacttggaacttcaaccttattcagaagactgctccttcagaggactgatcccactcgctctctctctctctcactctctcactctcgttctcttttcacaagagaaagcatctcctgtgagcagcctgtagctgcccaatgactgactgataaagaattatgaaagcccagcttccttgcctgggggcaggacagaatgagctgtcattcacactccagagcttccctatgggatcaggctgctgctgactttgcctgagatctcatcttgcctggatttctccccttccctgttctgctttcctcaccccctcactagtctccctgggagcactttcttactaaacctcatgcacataaatccgtatctcagaatctgcttctggggagctcaacctaagatagtggcttagctgggttgccaacccaagccagtgtgacaggaaactttgtgtcttctgtgtgacataaaaccatccattgtttcttaaattccatttgttttatttatttatacaaagtcgtgttcttgttgcccaggctggagcgcaatggcgcaatctcagctcgccgcaacctctgcctcctgggttcaagcgatcctcctgccgtagcctcccgagtagctgggattacaggcatgcgccaccacgcctggctaattttgtacttttagtagagatggggtttctccatgttggtcaggctggtctcgaactcccgaagtcaggtgatccacctgcctcgacctcccaaagtgctgggattacaggagtgagccactgcgcctggccttcttatatttaaattaacttttcacctcatgctttcagagtttctagactctgaaatgaaactctatagacaaaaactaagaaatgctgaatatctgattttctcattttcagaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtgggtaagaaaatgccacagcccttaggaggcacttgctttgggaggagcagggggtgttcacatcgtggattgtaaagggagcatcactattcctcctgtaaggcctaagcatgcaactttgctctcagtagcatcactggttctctggctcagccctagatctaacctcagtgtctatcctggagctgacttcgtagctgatggcttccatctgacttttgtctttttcttggtttgctattgaggcaactacaggctggcagagatgtggcatactcctgctgattttagttcgggggcctgagcaaagttattgacactatagggacagtccagtagagaacatctatgtgtctttcagccccaatgtagcttctttgtcattgactctggtggtcagcaagcactcaatttgttcagctggaagggatttggatattttgccttactctgggtttgttgggcagtgagtggttcccatggtgtggtcctgggagcagaagcagcagtagcatctcctggtctaagaatgcaaatttttaccaacccacccccaccacctgctgagtcagaaactttaggggtcaggcacagcattttgttttttaatgagcattccagggattgtgaggcactcaaatagagagctactgatctaaggcactgcttctcaaactttactgtgcagcgaagtcctctagggaccttgggaaaaatgcagatttaaattcagcaggtctgcggtgggtcctaggattctgctaaacgatgctttagggcaaagtttctgaacctcagcatgatggacatttggggccaaataattctttgttgtggagccctgttttttttgtttgcaggatgtttagcagcatccttggattttattcactaagtgccagtaacactgcccacagggggcacctcacagatgttgctttcaatatcctccctgtgattagctatgtgcatagctcttcaaaacaaaccaaaaagaaaattgaatctactccctcatattggaaggggcagaggtgatggtgggaggagagaagctcaaaaatctttctgctaagcaagctttggcagagtactctagggatcatactgtttaaatttccagattgtgtgcaacaatggaaagaaaatgctgattgttctcaaaaaccaacagcatgtcttaagctggaccagatgcgcctggaaccttcccagaggaagagagaatgaaccccaaattcaggagattcatattacagtttgtcagaacaaggttcaggcatatttgggagaaggaggattgtacatgcaattagttagggatgacaaaaaggggtacagcgatccacaagagagcctagagctcccaggaaaaaagagagaaatgggcaaagcaagcaggcaattctttctttgattttcgcgacagacaagctgaggtttgtccccagtgaattttactccaggggtattatttacttttttggctttaaatgtattaaaatagtttaataaatttgtttttgtgttgacaggggtagggggtccttgagcgtaactcagaacttcaacctattttaggaggtgacacatagtggctaagtagttcccagatttccacacaaccttcaacagtcttggccagagctgtactgagtggtgagaaagttgtcccagttctcttctagactgtgagggaagagagaagactgggcttactttggactctgaggtggtcagttctgtggtctggctaatttgaaggtgccacaagttaaaattaattctcttacacagaccatactctggcaatgagctgaaattcatagttatttcagaaacagatatagataaaaataagtcaatgtaggaggaaaaaaaatactgcaaattgcaggagggtaaaaagtctttgaagagccacaacctccattgatctggaagaaaataaaccttagaatgtaaccactattgttttcgggggatatttttctttctttccatttttagttatttttggttatgttggcatttagatagaacaatgaacagttggaatcacaacaagtcctcatgtaaagaccagattttgagtagacacatgatctctcctttagaccaacacttcttcctaggccaaaacaggaagaaaacaaattaaagatactttaaaaaccacggacaatgaaaaaccagcaaaggtcttttgacattcagagagtatccatttaattactttaacaaaagacaatgtacaaactttcctttttgccctgtggaacggattgtaataaagtgaccagacaacacatttaagttctaattatctatcaaggaaaaaatatttttaaataaatatattttattttttgctcacttattttttgttttctacagagtagaataggtggagatttattaacacaaatgaaattctggaataaaacattttggagatgtaatatatggaaattgatggcatacgtttcttgtgtcccagctgtctcacagctggtttacccaatgacccataggaatgggatcattgcattattgctgggctgcattgcattattcagttgatgcaaacatcagtagggctaagaatgaatgtatccatgcattgttgcaaatgatgttaaattgtgctaaattcttcctgggttgacaaatacacattcttttgcaaactttcagaggctagtttcagttaaaacaacttgattgactgagatactgattcactttttcccttacatgatttgttagtacaaacagaacaggtcaacttttagtggctctctctaatataaatgtatcaccaatgaatttttatttgggcttctttcttgtgaagatgttgacttttagagatgaggtctcattatgttgcccaggctggcctcttgctatgtcgtccaggctggtcttgaactcccaggcttaagtgatcctcccacatcagcctcctgagtagctggggctacaggcatgagccaccacacccggctatgatcatgacttttaaatgtggatttcattgcctcccttcttgcctcttttgtctgttttggaaagttctctggatttttgtatggtgccaaacagaggaaaccacttcccagagccatccacagagattacgctctggctgggggaagcaaacaactggatgagttttcaatggccaggtttgttctgcatttggcagtcactcacttcctatgcccccttgaaaagaactcttcctttctctatcaccaaactcaaactattttatatttgcatcagtgatctgttgctgcacaatagaccacacaaaacttagtggctccaaacaactatgttattgctcaaagattctatgggttggaaagttgggcagagctctgtggggacagctcatctctgctgtatgtggtaatggttgaggtgaccaagtggagctggaggattcaagatggcttcactcacaggtctggtacctcagttgggaaaagttgtactgactggggtctggctgagtctctttctctctctctctctcatttataatttctcatcctgattacatggcctctccagtcaattggacttctttagatggcagctggcttttaacatagtgaaagcagaaggcaccagattctttgagggcctaggtctggaactggcacagggtcacttcccttgcattttattgttatctgttgggcaagactttgtccttttgagcttcttccttatttccactacctaccgggttagatgtgtcaaggatttccaagtaaatagttcagcttcagctgggtgctggtggctcacacctgtaatcccagcactttgggaggctaagacaggcagatttcttgagcccaggagttcgagaccagcctgggcaacatggcaaaatcctgtctctacaaaaataaataaataaatgaataaataaaatcagctaggcatggtggtgcatgcctgtagtcccagctacttgggaggctgaggtgggaggatcacatgagtctgggaagtcaaggctgcagtgagccgatattgtgccactgcactccagcctgggtgacagagtgagagcctgtctcgaaaaaaaagttcagcttcttagataaatagtagttgatacaatgcaatatatttgtatctcatattttatatgcacagagataactagagcacagagaagggagacagtttgtcagatgtctccaatgaatgtggcagagagcaaaggccagaattttcactgaaggtttcaagatttttatataattgcaggcatcctaattcaacaggggatagtaattatgtttctatagtaactttgttcctttcattcatggaaatgtataacttataaaatgctatcggggccaagtctgggtaataacaggcttaggtctctggagcatcagctgaagggcagaccagcttgtctcaccagccgagagagaaggcagctgcttgaggatgtgtcaggatcaagtcctgcagaggctcttcaagggttcatggggaagctatgacagaccatcacaaaacagtatgtgtgcaaaggttggcggaaaacactaggtcagcagcaggcagatacacaaaagggtttggtttattaaaatagctttaaaatatgtaatggcatttaaaaatcccagaccacaaagaaattccaaaagagaggaaatgcttcttcccagtctataaatgaggatgctaataacactgcttagtctaatgggtggttgtgcaaattcagtaaaataatatagggagggtacttagcatggggtgggcatgtaggaaggagtcctccaatattagttattatttgtaatgatttatttcttcttgtttcttctttggaagagcactgtttctgaaaagctaggccagttcagctgatcattgttagctagagataagctggctttgggaaactctgagactcttcacccagataacctatcttggagcctgtgtgcttacactgttagtacatcttgatacagaaaacaaacaacaatgtatcatccagacatttagtttacctgacagagactaagttgcttttcactctgaccatgctgcaccaagaaaatatggtaacacaatgtaattttacattgaaatctgtatgctaataaatatactttctataatgtaattgccagctatatttgaccagcagggggcagtcattatatacttgtctttctgtgaaatgttcatctgaattataaaagtttgtcttctatcacctatcatagtaaaaaattaaatgtttttaaaaacgtaacagctgagtatagacatcttgaatgcatttaaagcatcttccatttcatcatagtatttgtatactttattttatcaattctgagaagcgtattatttctaccttttaatatccctgaaatagggatgcatttcacaattaggagtgacttagattcaacaaaatatggtggttattcaatttaggattggtgcattaaggctgttaagttcacactccactgaagcacgacatagaatgaaaatgaatttggatagctgaaggcaaaattgtttaataagttattcgtaacttcttaccctgaataaaatgagaaattattagacaagacacaggagaaagtatataaagaattttacttggtgcatttagtctctcaaagacatctgtcattcagaatcaaaaggacatttaactttcattaaggcagtaatagcacttaatacttatcagttgatatgtaaagtaacatgaagctgaatgtccttaatttgctatgccttctttaaatacattctctacctgttcagaaatattaagtagaatttgcagaaatgtgaacttcctcttgtgatttcacttcagctataagatgaaatacaacccagtgtagagttgacatctcatttactttgagccctcattaaccacccatccttgttatcactatcgaggcagaactcctattaccaggtagagaaactacttgaagaaatttgggaggcttttggaggtccagagccacagtaaaactgctgtcccagaacataaaaccataagtgtagttcagtagcagttcaaggggagagtggacccagacagaccattgcctattttaagatattaagcaatatgttgataatagatagcaggaagagagagagcttgttccagtggcaagtgctccgacttagattgtaattcacagtgccattatctacatgtgtggtcttaaataaatcatttaagttctttgagcctcagtttgcacatctgtaaaatgagagagttgggcggctcctctacacctccatagcattcacttttaccttgcctggggcaattgccattttctacctcatgttatatttcatgtgtgataatgtaatccctccaatacatggcaaattctctgaaatgtcaggagcacatgattctcttgcctttgtgcacccccaaccccagcagttggaatgaagccttggataagattggtactcatgaaaaatttgttgccttgaattgaatctgactagatgatagctagaatgcctttctgtaatattccatgatgctgtgttcaaagcaggaagtactcactaaagccaaatgacttctagtttcagctgggtaactgccatgtggccttcggtaggcagagtttggaagcatggggaggaaaggctgtaactaatgaattacccacaggacaccttgcaaggccagttgattgcaggtttagccctgcaaatgtgagtatttaaacaatcttcaaaacttagcaggagagtaaaagcattatgaagggagaaaaggggaatatatagggtgaacaaactctttgaaaatggagaatacccagaggctttggtattttaaactgtgggtgttgaaccccagtttgactagatatttcttgatgatgatgagaatgttttggttatattttcagatatggaacctcctagaatcaagtgcccaagtgtgaaggaacgcattgcagaacccaacaaactgacagtccgggtgtcctgggagacacccgaaggaagagacacagcagatggaattcttactgagtaagtgaaacttggcagataaaatgatgctgtctcttttatgtgagatgtttactacccagagtaggggagtgtatatatgctggtctatttatgctttcagatgtggtccccctggtcactacctaacatactatatatgtcacctatgtatttgttgattgcctgtctctattataatatgttcactgctatgtccttaatgcccagaactgtgcctggcacatagttagcactcagtaaatccttactgaaggaaaaaggagaaataaggggtggtgaatgatgtgattattatgcattgcatgcctgtatcaaaacatcttggctgggtgcggtggctcatgcctgtaatcccagcactttgtgaggacgaggcaggcggatcacttgaggtcagaagtttgagaccagcctggctaacatggtgaaaccccatctctactaaaaatacaaaaattagccaggcatggtggcacacacctgtaatcccagctactcaggaggctgaggcatgagaatcgcttgaacctgtgaggctgaggttgcagtgagccaagattgcaccaccgtgctccagcctgggtgacagagtgagacgccatctcaaaaaaattaaaaaaaaaaatctcatgtaccccataaatatatatacctaccatatactcacaaaaattaaaaataaaaaaaatgtaaaagaaggggtggtgagaagaagggaaggaggaacagaaggggaaagaggaagccagttggttaatttaagaatagagccacccccattgcctgcccaggcagaccctactcatgcccccaggccattacctgcactgggaagccatctgtgtctcccaggtggtgccaaaggctgccgctcttgtgctctgtgagtacagtttagtgcaaaactttttcaccccttgttttttggctgtatttatctctttcaaagctttttaatttatttttaaaactcccgatcatatcaaacacttacagatgcttatttaaaaaaagagaaggtatcttctgctttcttccccacctctaccccattctcctggaccaatttcattcatagtttgacatgtatctgagttgctttttgttggtgtgtttgttttaccaatcacaatgagaagcactgttaagaagcttttaaaaatgggtggatccctttgtgagggttagctatgtgttgttctaatctagcatttgggcctgtacccctgcaactgtttggttggccttcatattccctggagaccactacttcatgttagcacattcatatctgtgccttaaagtttatgggcatattagagttccccactgagttttcatctgtagatgaaaggatacctctaacttatctcctggtgatccataaagcaggaaaagactttctagaatcctatcaacccaggctgtgcatgacaaaacatttttacacaatgattagcaataacagtacagtttctagtgagaggagacaggacattttgttcctacattccaataatcttcccccagtgcctcatctagcttaagtagtattactagttatgctctcccattgtaacttctcaaagataaagtttgaccattaaaaaattatttgctgtcacatacacatcccacaaattcctttggagaaaatgtaggcaatcagaattgaaaagtaagttgatgttatcagggattgggttttatttacctttgactcttcagggtctagcacaatgtctggcccagccccagcacgtagtaggtttttagatttttgcagctctgactgctgttgaaaaaacctgtgtgataaacacaaaacatcaagccatcagatgactctatttgtctacaagctttgtgagaatattcaccttgttctttttatgggtaacttgcgtaatatggttaggagtgttacattttatttgatttttttattttttgagacagattctcactctgttgcccaggctggagtgcagtggcacgatcttggctcacagcaacctccgcctcccaggttcaagtgattctcctgactcagtctcctgagtagctgggattacaggtgtgcaccaccatgccctgctaatttttgtatttttagtagagatgggtttttgccatgttggccaggctggtcttgcactcctgacctcaggtgatctgcctgcctcagcctccaaaagtgctgggattacattcatgagccactgcacccggcaggattgttacattttaaaacagcatctcagtattctcctgtccctttgttcagagcagctgtctgcttccagagttctacaacccagaggccagaaaggcttagagcaggatgtggtgggaatgcactccaacaggatgaggagttcagagaaggctgtcttgttcccttttcgctctcactagggctccttgctgccctggcatttctcctatgaccccttccaccatttcctatccaagctactgctctatcgctcccttgtgagggagaaggttctagtgtcaagctctgagacaagtgcttcttgtgagttcccttatttactccttctgttatttgcatgtcacaggtgaaacaaagtctcagaaaggttacatccacttatatttgaagtatcactcctctcaggtttatctgaatttaaactgtgctttctaaagaccttaaagcatctaaagccaacagcagcatgtctcaaaatagtgggatttctgacattttcccaagacccctctctcatacctggtaaacagccacctcacccacctacatgtaaggctttcctcaatggtgacaatgataattccacgtgttcattattagcaaatattctcatcattcccagaactgtagggagatggggaattatatgtatattgaaaaacagaacgtggattttgatcctgctatacttattggtgtcctcattaggcagccaagaaaaaagataaactcaccctagctgtgtgaccttgggcaagttctttagcctttttgtgcctcagtttcctcatctgtgaatcagagataatactacctaccttatagggttgttggattaaataaggaggattaagtaaatatatgcaaaatgcctagaaccatgcctaacatgtaaggtttatgtaagtgcaaagaacactttttgtcattattattatgttattaggataaccaaggaatcacagagaacttgcctttaggtctccactgtcccagacagaaagaacagagaaagttctagcacccacccccgccccgcaggcccaaattgccagtgactgcttggactatattctctaatgattttcctcacagaaaattccctcgtcttcccaacagtgaggcaattcaggtcccccctggaacaagagtgagattgaaggaggagacttgggccctatatttttcatcctccctcccccctctacccacttccctaccattctacccttcagcaagaaaaaagtctaagcttcccagtagtttgggtcttccattttctggtcacaaactgctcttctaaaacagactaaagcttaggagattctattcttcaagaaatttttgttttatttaaactggtctaatggttgcccctcagtctctccatgtcctgtaaagagtaggggatcgtcacttgcttgtcaggtccataatgtcatctttcctgtttctgattttttttctctaagtgtcattctaaaaggcctccccccaggctccaactttccagaaggagaccacaagatccagtacacagtctatgacagagctgagaataagggcacttgcaaatttcgagttaaagtaagaggtaagagtactgcttattggttttgtttccccctctctttagaagagcaaagggaagtaggtcctcaagccagaactctctcaagtgcctactgtggtgggagacttgccagctttagattagtctctaataaggcttggggaagtgccctatcttaatgcctgaatttcacgatacacatccggatgggcgtcagtgttgccagattatttaaggagttcccaggactagtcttacaggatcccatagctgactgtcctagaagaatattattcaataatttttccatccctgagcttaggtggccagctgaagcctgtgagtccatctacaaccagggtgaataggagccccctaatttgggccaccaggagaacatgtttttagtgttctagtaccattggtatgaaagaaaatgtttttaaggattattttatgcctgatggtttgggcaactaattgctaaccatctttactccttactcttctggacttcacttcctcatctataacactaggggcgaaaccagttgatatcagtggtctcattggtatggatggtgaccattgcaagactcactcactgaccaaatagtcatccctcctccctcactcatttcacaggctgatgtagaagcctgattgcaaagctgatgcctctgcatcctcaccttttctgcttactctgtggatgggagctcagcactgagacccctctggacttgtgtccctacagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcaggtaggtatgccgcccctccagcctgcagcagaacctgtaaaccccttggttcttgattccagtgcaagagaggtttcccttcatatactttgagaagttcatggccatccctctttatctgagtggatgaacatagtccctagatccctgctgcagctcatctcatctgccatccatcttgcccctgcctatcctctaatttccttttcatgtcctctaaggaagaagctcaaggtaggaacctagggccagcctttggtgacattatgaatcagcaaaatttgctctagtttcctttgttctagaaatgtaaggatcttatttataaagctagtaaattgccatgtagagacaatatcatacctgctttgcatcactggcatgaaagttacatagactttgggcatttggaatctttcctcctatgtaaaatgaagaaaataatacctcatctacctcttgagttgtaaggattaaatgaggtcatctgtggaacagtggaatagagcagtgcctggtacaggcaaagccttatgccagctcttattcctgatgaagaaaaattgggctgggtaatgagtctgaaacttggactagccagaaaattatgtatgtatctcttgtttatagacttctctttttctcatttcctggcaccctttcatctttatcactttcttttaattgaagcccccatttagagttaagtgacagagagacatatataccatcagctaaatgcctgagattcttcaatttcatgtattaaagtagaaagaacacacctattatagactccctacctaaggacttcatgcccaccacctatgaggctattctgaattgagatatgctataagtgtaaaatatataccaatttcaaaatcttagtgtgaaaaagaatataaagtatcttaattttttatattgattacatgttgaaatgaaatattttggatatattgggttagataaaacataaaatcatttctacctatctctttatattttttatttgtttgtttgtttgtttgtttgagatgtagtctctctctgtcacccaggctagagtgcagtggcgcgatctcggttcactgcaacctctgcctcccgggttccagtgattctcctgccccagcctcccgagcagctgggactacaggtgcctgccaccacgcctggctaattttttgtatttttagtaaagacggggtttcaccatgttagccaggatggtcttgatctcctgacctcgtgatctgcacgcctcggcctcccaaagtgctgggattacagatgtgagacactgcgcccggtctctttacacttttttaatgaggcaactagaaaatttaagattaaatatagtggcttacattgtatttctcttgaccagagctatcctagactctgagtccctggggcagggaagagggcaggaaagagggcaggaactgtgtatcactcagtgtgacatcctagtacctagcatagagcttggcacatggcaggcactcagtatataatggctgaatgaatgaatgtgtgaatgaacaaatacttcaatgcaaacctaaaatgtgaaatatgaaaaccaagattataaatcatacatggcatctactagtttttctcttattatttcttctctggggctaagccttttgcttgcctatctatacgacatccttcattgaccttgaacagctggaattagttgtcatttatttgcttaaagggaagacctattataaaaccgccttgtcccatgtcctgtttgcctgtgttgtttgctctgtggcctttgtgccccacattgctttgtcccttctgcaccaaggaggcagacttcagagattctgagccattccaaagccagcctggccactgcccattctcttacccttctgcctctctgcacccctttccccagcagatactatggtgcttggcccatatgcctttcacattcccatctgtgttcaaaaggctacttactgcaattaactgggtctgtctgtctgagagcatttctttcctggctatgaaagcattgtcagcccatgcacagagccagctggaagtgatggagagttagtgccccagaagcagccctcagcaatgatggagcaattgtataaatactccagttccctccagtgggttaattctggaggtatgttgtatatcatctcctagagttccccagtgggagtgagttccaaatgcccacagcaaaaacttgcttgataaccaattggtattgttttctttccttcactgtctcacttcctgacatagacagaataatggtccaccaaagatgtccacatcctagtccctggaacctgagaatatgttaccttacatgaaaaaagggactttacagatgtaataagttaaggattttgaaatgggaagagtatcctgaattacccagtgggcccaatgtaatcacaagccttcttatataaaggaggcagaactgatgtcagagtcatagaaagagacgatggaaggagaggtcagagagaagagagatttgaagatgctacactgctgtctttgaagatggaggaagggactactagccaaggaatgaatgtggcctctcgatgctgaaaaagacaagaaatcagattctcccctagaacctccatgggagcatagccctgccaacaccttgattttagctccatgagaccaggatcttttagatcctgacctgcagtatctaaaagaataagtttgtattatgttaagtcactaagtttatggtgatttgttacagcagcaagaggaagtgaatatacttccgtactcctccacaggcgcttcttgggactgcctcccaaataaactgtttacacttgaatccttatctcagggtttacttcttacacaaatggttctgtgtgtcatcataggctctgttgagccagaacaagtggaaggtttctgacccatgtggccatttctgattacagccatgaacgtcaatgtgggtgtcagaacggcagctgcacttctggatcagttttatgagaaaaggagactcctcattgtgtccacacccacagcccgaaacctcctttaccggctccagctaggaatgctgcaggtgagtcctcgaggcagggccaaggtgagagggagacctttaacaggaagggcccagccatttcactaaaagcaaaggccagattcagtgcctaatgcacttacagtgagtttcaggaagtggcactttagagctaccaccattcatttctggttctgggccataacctgattaacattgactccttagagttaacccaatcgttttccaactaatgaggtttgtctgtcttcaccaataagtctaattgacatgctgtccaggcctagccacagaacaattgtctttgccaaacctgtccaggatatgcctggctggaagcaatcaattggttgcctgcccacatttttccccagggaatttctttgactcagagggtgacagccattttttcttagaaaagtggttctcaacgtgtgatccatggaccggaccagaagcatcagcatcacctgggagcttgatagacatgccaattctcagggcccctcccagacctactgtgtcagaatctacacttttaacaaaatctccaggtgattcctaagcactctaaagtttgagggtcacttttctgggaaatgtgtccttctcagctatgtaaattttgtagctactaaatgaggcaaccaacatcttgggtgtgtggggaaggctgactagaaactgtaaggatcaaactagaaattgcttgcttttgtcctgaggctggtttgcaaaagagtggccaacttcactgaatactaaagaggcaggatgtatgctgtgccatggatacagtgctgcacatttttttgagactattttattcatttattacagtggatagaactaagtgcttagaacagtattgatttaatcaaaggctacaatttacttctcatatcagcattaataaaatggataataataagtctcttttcactcttcccacgtacttgaagaattgcctatgaactctgaagagccatataaaatttttgtgagttcccttgataggaaccaaattcattgcatctttacccctggtccccaccagcttacctccccttgtatctccttgtccaagccaggggcttgctcttcagaaaacacaagcttatacctctgtcttttgtgggaaactggcattgcaggctatattccatgatcatgcatttcctcatctcttcttattccataggaaaatgaattaagccaaacaacttgcttttcctctgtgtcagcaaactatggtgacccatggctagtttcggtaaattaacttttattggacacagccacactaattcatttgtgcatgatctacaactgcttttgcactacaatgatgggtgaagtggttaggacagaggcaatccaaccttgccaagcctgaagtactctctggccctttacagagaaagattgccatcgttgctctagtctgtcccatcccttcagacacttgctaacttaacaactggttggataagatattttatatcaagatgttttggtgtgccctcctcctccaaatatacttacatttgcattttaaccagagccttcaaagaaaggtttgattgacttaggcatttcagtgagagtaatacaaaagtctatttctaactttttaaacttttcaaccagttctgtaacctcatatagggacgtttcagtggaattttggtaaaacatatttgatgttttcgtctttcaagacttcaaaatttcttttcccatttagccaaattcatcatatttgtcttacattactttttttttttttattgccattgccattcctgatgagccctcctcgtggttgactgggccacattcccaaggttcttgccaagagccagcttagaggcttggaaccttttatcctcttttcccctgggattgggtgtggagggcatagggcaggggagtgtggagagtggaaacagggcagagaagtggactctggaaatagtcttctctccttgcaaagaaaaattagaatcctctggggtggtcttggatactttttaggaaatttgactcactcaaggtctcaccctgtctggaaatacatagactgcccttttgcttaggttttcaaaatcccactgtcaagccatatctgaatgattcctctagcaaaggtatttaggttttatagccactatcttaaccccaatttctcatctgttttcaggacagttcagagtgagcaaataaacttccagagacaggccagtgctgcttctgtcggtttctagtttgataaggatgtcttttttagccatgctcatacttcccctgttgggttttctttttcccagcaagcacagtgtggccttgatcttcgacacatcaccgtggtggagctggtgggtgtgttcccgactctcattggcaggataggagcaaagattatgcctccagccctagcgctgcagctcaggtagggggaagttctgttcttaaatcttatcccctgtgaatgcatttttaactgattaggttccctggtttctttctattcaggattgagttcaggcaaccttcaatgtttaattgcttttattctgggagtgttataaccatactaatcagtatgttgctgtttgttcaaataaattgtgcagtgggtaattaccagtgttctttcttactccctccaaccaaccgtttttgcttcatgtgtgtgtatgtgtgtgtgtggttggtggaggaaggatggttaggagaggagcacctgaagaaaagacttaagcaatcatggtcttattagaagagcatgcatccaattagacttcccaggcttggtctcttttttctccatgcttccagaacacttgttcatacctttattttaacaattatattttagtttcataacccttacaaagttggagccatggattttagtctctgaataatgatgtattaaagaagcagaattcaacaaccaaaaggtaatttcagaataacccaaatttctacttgcatctcttgaccactgtgaaatcgataattaggctaaagcaaaactccttaaaatcttcctttctcacccagccttttctctcacacactgcatgggagagtacagatctctgttttcagggtcccaggctgctccctgtctctcagggcctcaggcagttacaaacatctcgaacacgtggctttcaggcttctgcaaaagtggggaaagagagtaaaaactcacactgactcctttatgcttcacgttggaggtgccacaccttgctcactctcttagttcattggccagaactagttacatgattgcaattcacttttaagggaggctgggaaatgcagtctttctgtattgccagaaagaagaaaatgaaatgggacttggtaaaccctatcacacctgttcagaaggcacagaaattccttgagaggttatatgatagaaacatatccttagcaaatgatgctatagatagacacaatagcttctttctctaatttccctgttttccagctgcctttgacccatcccatgtttgatttgtaccactttccacccaaaaagattctgccacattcctaccaaggtaaaaaaaaaaaaaaaaaaaaaaaaagaaagaaagaaagaaagaaaaaactcagagggccaggatggaagaaaaataagatgattcatgagttctctttagtcggctgatgaatggagaaggctgggtacactcatatgcttttgtttttgttatattttactgcatttgcatgtagcacctccccataccgacttcagtagcagagctttcaaatattggctactcagtacctagcacagtacctggcaccatgttggcgctaagtggagtaaatgactcaaaatttcattgaaacagccttactatttccagaggtgataatagcttttaaaagtatattgtatatctacagttagtatacaaatacttcaagttgaagtgtacaaaacttaagacagagagttgtgttgatatctaaatatttatggtgaatattttcaaagtaggttttatgaagctgttgcttatttagaactacttgctcatatcctgtgtcaatgattttttaaaacttgttgcagaattttctgaatggtctttggattgaatgtgtgtgtatgtgtgtgtgtatgtcatcttcataaaatcttgatgtgattttaaactgtttaatctacttgaagaacagaaaaatgtgattaaaaaatacttgtcattcagattgtatatattggggctaccatagacttctataggctgaagataatttttaaatacattatgtcgtggttctcaaatttttaacctccatcagaatcccctggagggcttgttaaaatacgtattgctggagtctacactgtaggctctaaactgtgtttctgattcagtaggtctctggtcgtacccgagaatttgcatttctcgtgagctcccaagagaccacatggtgaggaccactggcctagttttttaccaaagcctttacagtttgaaatagaatttttgcccagcagccttcaaggaaagggtcaatcactattttgcagctggatgatagtccaggtaaatgtcatacagaaatgatcactcaggtgcattacctaatggattctgtgtcaggccggcatgcctgtgttatcaaacatatcagtgagaaacaaagagcttggcagaactttttccctttgaattggaaaggtgttttttagacaccttggagtctagtgcagaggaaaaaagatgatttaggcaaagaatgggaagcaaaagaggagaaggaaaagcataatgcctgcataatgtaaaaattctcttgtctggctattttcaaatagcaccaaggccgtgataaaacccttgaagggagtcaacagaaagaagagactgggtgcctggggttgcagggtcaccgcctaccttctttcttaccctcatttcttttttatctggaggtatgatctgattcatgctttccagaggaattttccagcaatctcaaggaagacagggaccaagaaagccatagtttctatacccacattattctttgagtctacagtgttccctggaagactttccaggaagaactccttccaatctgacgacagacacatatgtaactcaggcatactgtcggcatcacacctcatccccgattttgtgtggtgtttgatcattcatccccaagatttctgtggtctttcggccctagtgggatgcattcctgtggctgctgctagcctgctgatccaaccactcagctcttcccatgacagttttccctctttacattctgtgtcaatgaaggcacaagacttacacaggaatgtgtatggtagcagatggtggcaccgtggtggtggtggtgggggttcccatcctagtctcacaagcactataaaaaaaatgaatgctccaatttcttattggtcaccctttcccacaggcttcagccaccacattccctattcctctgtttcctgagagctccctgtaccagaactcctccacgctcccaaaagaaaactcaatatccttccccttaaagatgcagagcattttatctcttcattcacacctttgcagcctacattcgcgtgttcagaactcattaatgcactttgcagtcatctacttctgagctcccctcttagcactgcaggaaacctggcagaggtattgtcatgtcctctttatttcatttctagtcactgggagtgaactggcaatttagctccccactgggataaaatacaaattattcccttcttcctcgaaactccctcttaaaaggcagaaaaaagtagtttgtgttctatgtaatgattttttaaccttgatctgtttgtatgaggaaaacatattttactttaaatccagatggcagtgtatattctgcctcatacataatctcaaaatatctaaactgaaaaaaaaatctggagaagagactgagtgggctcatttattcattgggctcagcttatctgtttgtttgctttctctagctattcccatctaaatatgtttgtgttgatataaaaatcatattttttagtttaaattctagtgtggtagagcagaaagaacaccagacacttgaaaccacttcatattcttttttggaattatttggggtacaaattatgattaatcaagtcagaatacatgggctgtagaccaagctcaatcccttataactctgcagtcctgagctggccactgaacaggccagaactatcatgctgggaaattatatcaatcagctttacctagcccagagtttctcagccttggcactattgctatgtgggaacagataattctttgtttggtggggacagttggctgtgcattgcaagatgtttagcagcattcctggcctctacccactaaatgccggtcacatcttcactctccactgtgacaaccaaaaatatctccagacatggccaaatttcccctgggggtggggagcaaaatcacccctgttcataatcactgactttgtcctagtgtgtatgtggtcgtgcaacactagtcagcaaacgtgggttttgggttgattccaaacttggattgattccaatttaataaaaaaaatctgttagccttgtatgcaccttgtaccaaacgttggtatgtggcaccattgtacgcctgaagtcttcctgactataatctaaaaccaaagcagtgcttttcaacctctcaggtacataccagtcatctggggatcttgatagtaatgcagacactaattcagtaggtttggggttgggcatgagagtctccatttctagcaagttctcatgtgatgctgctggttcaagggtcacagttggagtagacagggtctaaaggatgattcagtccttcattgtatcaaagctttctctgcacactgtcacagtaaggctctggttgatccaccaggacccttgggagtcatggtttgacttagtctcctcttttctttgtctgccacaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggag

SEQ ID NO: 3314 - DNA, 71588 bp, human; identical to SEQ ID NO: 3310
